United States Patent 10,888,096 (BIOPESTICIDES FOR POTATO LATE BLIGHT DISEASE) - sequence listing, part 5

SEQ ID NO: 6 - DNA, 51725 bp, Pseudomonas fluorescens KENGFT3
tcaaagtgctcgccgccagtgacgcttgtgatagcggtggtgacggtctgatcgcccttgtagacgtcatccggcgccaagaccgaaacagtgccgctcgactggttcacaccgatagtgatggtctggccattatcgagagtgacggtcagcgggttggtgatgtttgtcaccggcgcgccgttcttatccacaaggctggcggtgtaaacgatattgccgccttcgcccacggtggtggtagcggacagcaccacatcgaccttgtcgatggtgtcgttgatggtggtggtagcaccgttgcccgcaacttccaacttctcgaagttaccgccagtagtctcggtaatcttgacggtctgagtgctcttgtcgataaacacatcatcggtcggtgcagggacagttaccgtgccgacggtatcgccagccttgatggtgatcgacgagccattatccaacttcaacgtaacgtcagtgcccgctttattggaaagcgtagcggtgtacgtaacctgaccaccctcattcgtctcagtcggcgccgtcagcgtcacagtggtggtgtcgatcgaatcagtaaccgtagtgaccgccggtgtcgtgctcggcaccaggctttcaaaattgccgccggtcgcgccggtgatggtcgtgctgatggtgctgccgttgacgtagacgtcattgggcggcgtgtccacgaccacgctgccgacggactcgcccgccttgatagtgatcaccgagccattgctcaaggtgacagtaacaggcgtctgtgccgggttggtcaaggtcgcggtgtaggtgatctgcccgccttcggtaacggtttcgccagcggtcagcgtgacggtggtggtatcgaccgaatcagtaatggtggtgaccgcaggcgtcgtgctcggcaccaggttttcaaagttgccgccggttgcaccggtaatggtggtgctgacagtcgaaccattgttgtagacgtcgttccggggtgtcgaccaccacggtgccggtcgattcacccgccttgatagtgatcaccgagccattgctcaaggtcacggtgaccggcgtctgcgccgggttggtcaaggtggcggtgtaggtgatctggccgccttcagccacggtatcgcccgccgtcaacgtgacggtggtggtgtcgatggtatcggtgatctgcgtcacggccgggttagggtcgagggtcaacaccaggttgccgccgccggtggtaccggtaacgctgacgctgatctggcttggatcgatgtaggggctgtcgttgggggccaggggcacattgacggtgccggtcagttggccggacgggatggtaatcaccgcgccattggacaaggtcacggtcaggtcgctggtggagggccgcgtaacggtagcggtataggtcagcacaccgccggcttcggtgatggttggggttgcgctcagggacagggtcgcgggctgcagcgccaaaccggaatcagcggtgcctggggcgccggccagtacgttgagtgtcgaggtgccctggccgagagggccggttggaaaaccgatggtcgggtcgacccggccggcggtggcgtccagcaccacgaagctgtgacccccccccgcggcgccattaccggcagcggttgcacccgcggccgtggcttccagctcggtggtcgggtcggcaccggcggcgatggcttgttgcagctcggccaccgatggcgcagcttgctcggtggcagcggccaggtcgacgctggagtccggtagatcggcgctccactgagtgtaccggcccaggtccagaatacggccgtcggccagttccaggctcactgtgcccgacaggccagtgtcgacctggtcgcccgcgaacaggcgatcaccttcaataaggacgcgacgagtgccttccggagaaacaacgaaaacttgaccaacaatgcttttgacgatggcaacaacactgctcattaaaattttctccggcgattcgttcgaaattccattttgcagcgcgcaattagggctgccaactggaggacgtagtctataaagcgattgacgtcaaatatttggctagattttttagtgatctagtttgtgccaaactattgaccttatggccgccatcctaaacaatcgctcccgtaatgtcacattgatatttaagcggcgaaccgtcctacatgtgtgaagcagttccgttttttgaactttccgacgtacggtcattacggtagccattatccgacgcagcggtgctaatcgctgtgatttgagacaagaagtcctggggaaatttttaaatgcgcctgcacctgttcaaggcaattccgttcgttctcgccgccagtttcgtacaagcccagacgctgccccaagccatgcaacaggccttggatgtgcacccggaaatccaggcaggtgttaatagccgcatcgctgctgactatcaactgcgcgccgcccaaggtggctacctgccgcgagtcgacctgaacgccggttatggccgccaagggaccgacaacgccacctcccgtgccaacaaccccagcggcaatcactgggacacgctcaaccgtggcgaatccagcctgcgcctgcagcaaatgatttttgacggtttcgccacctccagcgaagtcgggcgtcaacaagccaacgttaatgcccgtgcctactccttgctgggtacttccgagcggacggcgttgaccgttgcccaggtctacctggaagtgttgacccgccgtgagttcgtgcgcctggccgaagacaaccttcgcaatcacgaacgcatctacgatcagatcaagttgcgcacgcagcgcggcgtcggcaacggtgccgaccaggaccaggccgaagcgcgcctggcccaggcccgcaacaacctgatcaccgagcagaccaacctggcagacgcgcaaaccaactacctcagcgccgtcggccagatgcccgaccagctcgagcgcccggcgccgttcatggccatgctgccggcggacctgaatgaagcccgtcgccagatgctcgacaatagcccggtgttgcgttcagccgagtcggatatctccgccgccgaaaaacagtacgaagccgctaaatccagcttctacccacgctttgacgctgagcttggcaccaacgccgacaacaacgtctccggtgatccaaaccacagcaacggctgggaagccatggtgcgcatgcgcttcaacctgttcgccggcggtagcaacaaggccgacctgcaatcgaagtcctaccaggccaaccaggccctggatatccgcaacaacgccttgcgccaactcaatgaagagctaggcttggcctggaacgcgttgaataacgccaatgcccaattgccggtggcacagcagtacgtggatcacagctcccgtgtacgcacctcctaccagcaacagttcagcctcggccagcgcaccctgctggatttgctcgacagcgaaaatgaattgttcaccgcttcccgccgcctggaagaaatcaagaacattcagttatttactcagtatcgaatcaaggcgaccatgggtgaattgctcaagagccagggagtggtcgcaccaatggcatccgtcgtacagaacgacgtgaaacctaaagtccaactgcctgggatgaattgagccaccccaatagccccatctgttagtcgagagtgcaccgcgtggaacctgaaagcagtcgagttcatctcagtcatgatccacgcgccctgcatgacgacccgttgctcgacgggttgttggcactctgcgccctgcatcagaaaccggccagcgcagcgatgctcaccaccggcctgccgctgccctcgcaacgcttgagcgccgagctgctgccgcgtgccgctgcacgggccgggctgcaaggccgggtgctgcaacgcaagctggaacagatcccgaccattgcactgccggccctgctgttgctcaaggacggtcgcagtaccgtgctggtcggctgggaaggcgaggatgaagcacggatcctgctcagcgaaagcgacggcggcgaagtgctgataaaacgtgaagcactggcggacgactacatcggcaaggtcttcttcgcccagccgcaacacaaattcgacgtcaaccacggcagcctgattccacgggcgcggtcgtggttccgtgacaccctcatgcgttcgcgctggctctataccgacgccatcgccgccagtttcctgattaacatcatcgccatggctgcgccgctgttcgtgatgaacgtatacgaccgcgtcgtaccgaaccaggccaccgccaccctgtgggtgctggccgtgggcatctgtggcgcgtacctgttcgacctggtcctcaaaagcctgcgcagcctgtgcctggacctggccggcaagaaaaccgacctgatcatctcggccacgctgttcgaacgcatcgtcggcatgtccatgaagtaccgcccggcacgggtcggcagcttcgcccagaacatccatgagtttcaaagcctgcgcgacttcctcgcatcgctgaccctcaccagcctgatcgacctgccgttcaccttgctgatcttcctggtgatcgccatcctcggcgggcatctggtgtgggtgccggtgctggcgttcccgcttgccctgggcatcggctatgccctgcaaaagcccttggtggcaaccatggaacgcaccatggccctggccgccgagcgccagtcgagcctgatcgagaccctcgccgggctcgatgcggtcaaggtcaacaacgctgagagcgagcgccaatacggctgggagcagaccatcggcaccctgagccggctggagctgcgggtgaagttgctgtcgggtctgtcgatgaacatgaccctgctgattcagcaattggccggcgtgatcatgatcgtgttcggcgtgtaccagatcatcgacggcaacctcagcatgggcggcctgattgcctgctacatgctcagtggccgcgccctgagcccgctggcctcgctgtcgggcctgctgacgcgctaccagcaagccaaggtcaccatgacctcggtggaccagatgatggagctgccccaggagcgcaatttcgacgagcgccccatgagccgccgcaccctgcaaggcgccatcgagtgccgggggctgaatttcacctacccgaaccaacagaaccctgcgctgaaaaacatcaacctggtgatcaagcccggggaaaaaatcggcatcattggtcgcagcggctcgggcaaaagctccctggccaaattgatcgtcggcctttaccagcccgactccggcgccctgctggtggacggcgtggacgtacgccagatcgacgtcagcgaactgcgccacaacattggctacgttgcccaggacatccaattgctcgccggcaccttgcgcgacaacctggtatccggggcgcgctacgtcgaggacgaaatggtcctgcaagctgccgaactggccggcgtacacgaattcgcccgtctgcacccccaaggttacgagctgcaagtcggcgagcgtgggcagaacttgtccggcggccagcgccagaacgtcgccctggcccgagcgctgctgctcaacccgcccatgctgctgctggatgaacccaccagcgccatggacaacaccggtgaagaacgcttgaagcaacgcctgcaagccgtggtgcaaaacaagaccgtggttctggtcacgcaccgcgcctcactgctctccctggtggaccgcctgctggtggtcgaccgtgggcagattctcgcggacggcccgaaagccgtggtcatggaagcgttgaagaaggggcagatcagtgttgcttaactccatcaagagtgcggtcgggcgctatttcaaaggttccgactcgctgcagggccagcccctgcccgaggtcaacaaagccctgatcgaagatgcgccgcgggtcatccgcctgaccatctgggcaatcatcgggttcttcgtgttcctggtggtgtgggcagggttttcccagatcgacgaagtgacccgtggcgacggcaaggcgattccgtcgtccaagttgcagaaaatccagaacctggaaggcggtatcgttgccgagttgtacgtcaaggaaggccagatcgtcgaagccggtgcgccattgatccgcctcgacgacacgcggtttgtctccaatgccggggaaaccgaagccttgcgcctggccatgcaactgcgcgtggagcgcctcagtgcacaggtggacgatcgcccgctgaacatccctgacgacgtgctcaaggccgcgccgagccaggccgccaacgagcgctccctgtatgaaagccgtcgccagcaattgaaagacgaagtcggcggcttgcaggagcaactggtacagcgccagcaagagctgcgcgagttcacctccaagcagagccagtatcgcagccagttgtccctgcaacgccaggaaatcaacatgtccgagccgctggtagcccagggcgcggtgtcgccggtggaagtgctgcgcctcaagcgcgccgaaatggaaacccgcggccagttggacgccaccaccctggcgattcctcgcgccgagtcggcgatcaaggaagtgcagcgcaagatcgacgaaacacgcggcaaattccgcagtgaagccctgacccagctcaacgaagcccgtaccgaactgaacaaggccgaatccaccggccgcgccctggaagaccgcgtcagccgcaccctggttacctcgccggtacgtgggatcgtcaagcagttgctggtcaataccgtcggtggcgtcatccagccaggcagcgacatggtcgaaatcgtgcctttgaacgacaccttgctggtggaagccaagatccgtccgcaagacatcgccttcctgcacccggggcaggaagcggtggtcaagttcactgcctatgactacaccatttacggcggcctcaaggccaagctcgaacgcatcggtgccgacaccatcaccgatgaagacaagaaaaccacctattacatgatcaccctgcgcactgaccgcagccacctgggcaccgatgagaagccgctgctgatcatcccgggcatggtcgcctcggtggacatcatcaccggcaagaaaagcatcctcagctacctgctcaagccgatcatcaaggcgcgggccgaggcgttgcacgagcggtaaatctccagcgcctgtgccggcctcatcggaggcaagctccctcccacatttgactgcgttcacaattcaagcgtgagagggggcttgcccccgatagggccatcagcatcaccttggatctcaaaccaaacgccatatcgatatgcatcaacggtatttaaacttcctttcttatacctataaattcactcccctgaccgccggaagtgaatccaatgtccgccaccgctgctgcccccaccaccgcccaaaccttcaacatccgcccctttcccggcagcgtcggcgccgaggtcatcggcctggacttgtcccgcccggtcaacgaccaggactttgcccgtatccaccgcgcgcacctcgaccaccacgtcgtggtattccgcaaccagcgcatcacccccgcacaacagatcgccttcagccgccgtttcggcgtgctgcaaatccacgtactcaaacagttcctgctggccaaccacccggaaatcctgatcgtctccaacatcatcgagaacggccaacccctgggccttggcgatgcaggcaagttctggcactcggacctgtcctataaggaactgcccagcctgggctcgatgctccacgcccaggaactgcccgccgaaggtggcgacaccctgttcgccgacatgcacaaagcctgggagcaactgcccgagcacctgcgcaacgccgtgcaaggtcgcagtgccgcgcattcctacacggcgcgctacagcgaagccaaattcgaaggcaactggcgcccgaccctgacccccgaacaactcgcccaggtcgccgaagtggtgcaccccatcgtgcgcacccacccggaaaacggccgccaggcgctgttcgtcagcgaaggctttaccacccgcatcgtcggcctgcccgatgacgagagccgcgacctgctggcccagctctacgcccacagcgtgcggccggaaaacatctaccgccaccagtggcagcctcacgacctggtgttctgggacaaccgctcgctgatccatttggccgccggttgcccgagccatctgcgccgcaagttgtaccgcaccactatccagggggatgcgcctttctgaaccggtaaagcctgctaggattgcgcccagttcactctcaattgctcacgagtgcttggcatgcaactacccgacatgaacctgctggtcgccctcgacgccttgctcgatgagggcagcgtggtcggcgctgcgcggcggatgaatctaagcccggcggccatgagccgcactctcacacgtatccgcgaagctgtaggtgacccgatcctggtgcgtgctggtcggggcctagtgccgacccccaaggccctggagctgcaaggccaggtgcgcaaagtggtggagcaggcggcgttgctgtttcgctcggccgatcaagtggacttgagcaccttgcgccgtcgcttcagcgtacgcgccaatgacttcttcatcggcgtgtatggcggtcggctgttcgacaccatggagcgcgtggcccccttttgtgagctgcgtttcgtacctgaaggcgacaccgacgacgaagccctgcgcgaagggcgcctggatctgcgggtgagcaacaccatgccggccagcccggaagtgaaggtgcagaacctgttttccaccacctttgtcggcctggcgcggcaagaccacccgctgttcgacgaagaaatcaccgccgcacgctttgccagctattcccacatcagcatttcacggcgtggcattgcccgtgggccgatcgacaccgcgctgaatgagcagggcctggagcgccgtgtggcgatgatcgcgccgggcttccacggagcgatgttcatgttgccggaatccgacctgatcatgccggtgcccaaggaagcgctgctgagcgccaaacgcctgaatctgccactgcgcgccttcccgttgccgatctccttgccgaccctggtattggcccagtcctggcacccacgcttcgacaaagacccggcgcacaaatggctgcgcgagacgatgcgcgagagttgccacgccacctggctggaagctcaacccaactaaaaacctcaagccatgcacaatcaaatgtgggagggggcttgctcccgatggcggtgtatcagcttcacatcaggtggctgtcatactgccatcgggagcaagccccctcccatatatggattgcgtctggcgcacttataagcttccgataagtaacttttttgcagggtatagcctgattaaactgctcaggtatttatcattccgagttacctgttcatgacatccctcgctgcccccgctttccaggccgcagcccaacctgttgctccaagcccacccatgttcggcccacgcatcatcatcggcctggtcggcgtgctgctggcggtgctggtgtccggtctcaacgagatggtcaccaaggtcgccctcgccgatatccgcggtgcgctgtatatcggttttgacgaaggtacctggctggtcgcggcctacacggcgacgtccgtggcggccatggcctttgcgccctggtgttcggtgacgttttcgctgcgccgtttcacgctgtgcgccatcggtttgttcaccgtgctgggtattctctgcccgttcgcgccgaactacgaaagcctgctgctgctacgcaccgtgcaaggtttggccggtggcgcgctaccgccgatgctgatgaccgtggcgctgcgtttcctgccggccaacgtcaagctgtatggcctggccggctacgccctgaccgccaccttcggcccgagcctgggtacgccgctggcggcgttgtggaccgaatacgtcggctggcaatgggcattctggcagatagtcgcgccctgcctgctggccatggccgccgtggcttacggcttgccgcaagacccgttgcgcctggagcgcttcaagcagttcaactggcgcggcctgctgctagggttcccggcgatctgcatgctggtgatcggcctgttgcaaggcaatcggctggactggttcgagtcgggcctgatcaccttcctgttgtgcggcggtaccgtgttgctgatgttgttcctgctcaacgaatggtcgcagccaatacccttcttcaaattgcagatgctcggcttgcgcaacctggcctttgccctgatcgtgctggccggcgtgttgatggtgctgacttcggtgatcatcatcccgtcgagttttctcgcccaggtccagggctaccggccgctgcaaaccgcgccggtgatgctgctgatggcgctgccgcagttgattgcgttgccgctggtggcggcgctgtgcaacctgcgctgggtcgattgccgctgggtgctggggatcggcctgggcatgttggtggtgtgctgcatcggcagttcacacctgacctcggcgtggatccgcgatgatttttatggctggtacctactgcagattttcggccagccgatggccgtgttgccgctgctgatgctgtccaccggcagcattcaacccatcgaagggccgttcgcctcggcctggttcaataccgtcaagggcctggccgctgtgatcgccaccgcggtgctggatacattgaccacccagcgcgggcatttccattcaaccatgttggtggaccgcctcggcaactcgcccctggccgacacgcaggcgcagggcctcgcccaccgcttgcacgagcagaccgtggtgctgacctcttcggatctttacgtcgtcatggccggtgtcgcgatggcgttgatcctgctgattttctggatgcccacgcggatctatccgcctcgcgctccgacctgaccacaaggactttccatgaaacgcaaagacaaaattgccgtcgccgttattgctgtatttgctgtcggcgtactggtttacctggtcgcgccgggtgtgctgggcagcaagcgccagactaccaacgacgctttcgtcgccgctgatttcaccctggtcgcgccgcgggtggccggctttatcaaggaggtgttggtggaagacaaccagcgcgtcaaggccggccagctgttggcgttgatcgacgaccgcgactttcgcgccgccgcccaggctgccgacgccgatacgctagtggcccaggcccaactgaaaaacgccaccgcgaccctggagcgccaaagctcggtgatcgcccaggcccaggccacggtggctgctgaccgcgccgaagtggccttcgctgaacatgaactgaatcgctacaaccacctcgccggcgtcggcgcgggcaccgtgcagaacgcccagcaagccaagacccgcatcgaccaggccaccgcgcgtctggccaaatccactgcggtgctggcggccgagcgcaagcaggtggagatcctcaccgcccagcgtgacgccgcagaaggtgggctcaagcgcgcccaggcggcgttggaaatggccagttatcagctgtcctacacgcgcatcgtcgcgccggtggatggcatggtcggcgagcgcgccgtgcgagtcggcgcctatgtgacaccgggcagcaagatcctcgcggtcgtgccgcttgccgaagcctatgtggtggccaatttccaggagacccaactgtcccatatgcatgccggccaggccgtgcaggtcagcgtcgacagcctcgacggcgagttgctcaagggccacctggaaagcctggcgccggccacgggcgtgacctttgcctcggtcaagccggacaatgccaccggcaacttcaccaaggtagtgcagcgtattccggtgaagatcgtgcttgagccaaaccagccactgaccgagcgtttgcgcgtcggcatgtcggtggaagccagcgtcgatacccggccggccgcgcaacagcgtgaggtggcccagcaatgaaacacgtcgcctggctcaccttgagcctcatcagcctgagcgcctgcaccgtcggcccggatttccaacggccccaaggtccacaggtcagccagtggagcgagccccagggtcgccaagccgcaagccgcgccgtcagcgaccccttgcaggagcgctggtgggacgtattccacgacgagcaactttcagcactcacgcgccgcgccctcagcgataacctcgacctgaaactggccagcagccgcctgcaacaaagtcgcgccgtacgccaagtgaccaccgccgaacgctaccccaacgtcgatgccggtggcggttaccagcgcaagcgcaacagcggcaaaggcttgaacgatccctccggcgagaacggtcgctcggctttcaaccaatgggacatgggcttctcggcctcatgggaactggacttctggggccgggtcaagcgtgaaaccgaagcagccgacgccaccctggaggtcgccgaaaacgaccgccgcgccgtgttgttgtcggtactggccgagactgcccaggactacatccaactgcgcggcgtgcagaacacccgtgccgttaccgagcaaaacctcgacgtggcccgtcacagcctcaagctttcgcaactgcgcctggctgatggcgtagcgaccgacctcgacgtggccgaagccgccgcccaagtcgcggccatcgaagcgcgcctgccggacttgcaacagcgccaggaccaactgatcaacgccctgagcctgctgatgggcgagccgccccaggccctgcacgcacagctgtccaaggacgccgccgtgccgcaaacccagcgtcaggtcgccattggcctgccctcggagctggccgaacgccgtcccgacatccgccaggcagaagcgcgcttgcacgccgccactgccagcatcggcgtggccaagggcgacttttacccgcgcatcaccctgtccggcagcctcggctcccaagccatgcaactgtcggacttcggctcctggggctcccgcgcatttgccctcggcccgcaattaagcctgccactgttcaacggtgggcgcctgcaaggcatggtggatttgcgcgaagcccagcaacaggaagcggcccttgcctaccagcaaaccgtgctgcgcgcctggcatgaaatcgacgaccaactgacccgctacaacgccagccaactacgccgcgacagcctcgccgaagccgtgcgccagaaccagatcgcccttgctactgcgcaacatcagtacgtcgaaggtgtggtggatttcgtcaacgtcctcacggtgcaaagtgcgctgctggcgacccaggagcagtgggttgaaagctctaccagcgtgtccttggccatggtcggcttgtacaaggcgttgggaggaggttgggagtcggtgtatccgttgcagacagccgggagctgagcaacaaagagttttgtcagttgcgaaataagatgtaatgataattgctctcaataacgtgactgagcttttcatgagcatcgcgacggacggccagcaacagcttcacatcctgtaccgcgaccaccacggctggctgcaaggctggttgcgcaaacgcctgggcgaccgcgagcatgctgccgacgtggcacacgacactttcctgcgcctgttagtgtccgggcgtttcccaggcgacaaggaaagtcgcagctacctggcacaaatcgcgcgcaacctggtgatcgatcaatggcggcgcttgcgtatcgagcgcgcctacctggaaagcatcgcgcacctgcccgagcccgagtcgccgtccctggaaacccgtgcactgatcctcgaaaccctgatgcagatcgatgccatgctcgaccgcatgcccgataaggtgcgccgtgcatttttgctctcgcagtttgaaggcttgagctacgcgcagatcgccgagcgcctgggcgtcaccgtcagctcggtgcagaagtacatgacccgcgccatcgtcgcctgttaccaggcggtctacgaagaatgaatcacgatgcgcccatcgcgccggcgattgtcgagcaagccagcgagtggctgatgctgcaatggggcggcgaactgcaaggggaacaacgccaggcatttgcccaatggcaggcggccgatccggaacaccgccgcgcctggcagcgcttgcagcagttgcaacacacccttggcggcgtgcccgccgacagcgctcgcgccgtattgcgcgacaccccggatacccagcgccgcgccgcgctgaagttgctcggtttgctgttggtggccgggggcagcagttatctggtccagcgcagcgaaccctggcaggccgccttcgccgagcaccgcacggccacgggcgaaattcgccacgtcacgttgagcgacggcacgttactggacctcaacagcgacagcgccgtggacctgcgtttcagcgccaccgaacggcgtatccgcttgatccgtggcgaagtcctgctgaccagcggccacgatccctcccgcccgttgatcgttgaaacgcctgccggtgatgtgcaggccttgggcacacgctttgccgtgcgcgaactgcccgacgccagccgcgtcgacctctacgaaggccgcctgcgggttacgccgctgcatggcatggcggtgcatatgaatgccggtgaaagcctgtggttcaacgcacaccaaagcgctgcgctgccggcggtgaacgccaatgccagcagttggaccaagcaccgcctggtcgccgagcgccagccgctgggtgagttcgtggcccagttgagtcgctatcgccagggtctgttgcgctgtgatcaagccgtgtcgggcctgttattgacgggtgtgttccccctcaacgataccgacgcgatcctggcggccctggagcgttcattgccggtgcaggtccaggctgtgacgcgttactgggtgacgataaaggcgcgggcctgaaaaaaatatcgccggcgcttgtcggtttctgcacgccgtgcgggatacctcttgaaagccaatcaagaagcgttctcacggggagtcctgcaatgtcgcaccacccaatccaacccttggcccgcgctctgcgtcgtggcttgtttgctggcctgctggcaaccgcgccggtgctgccgaacatggctcaagccgaagaaagcaccgaggcgctgcgcacctttgacattcctgcgggcagcctcgaccaggcgttgaaccgtttcgccagtgcctcgggcattctgttgtcggttgacgcgacactcaccgaaggcaagcgcagcgcgggcctgaaaggacgttacggcataggcgcggggttggagcgcttgctggcgggcagcggtctggtggcagtgcagtcccagggcagttgggcattgcaggccatttccggtggcggggccttgcaattggacgcgacccagatcagtggccggcaggagcaggaaagcgcctggggcccggtggacggcattgtcgccaagcgcagcgcctccggcagcaagaccgactcggcgctggtggaaatcccccagacgatcaacgtgatcaccgccgccgagatcaaggcacgtggcgcccagagtgtcacccaggcgttgctttacacacccggcatgagtgccggcggctttgcagaccgggtcaagttgttcgacgaaccgacctcccggggtttctcgcccacaccgctatatctggacggcttgcacttgccttacggcggaggcagcaccgggggcgcgttgcagatcgagccgtattccctggagcgcatcgaagtgctcaaggggccggcgtccgtgctttacggccagaaccagccgggcggtatcgtcaatatggtcagcaagcgccccagcgaaaccccgatacaccaagtggtgttggaagctggcacctacgaacacaaaagcgcggccatcgacctgagcggcccgctggacgaggaggggcagttgctctaccgcctgaccgggctggccaacgacgcgcaagacgaaatcaactacgtcgaaaacaagcgccagttcatcgcccccagcctcacctggcggcccaacgacgacaccagcctgaccctgttcgcccagtaccagaaagacaaaggcgtgcccgaagcccaaggcttgccggcgtctggcacgctgtgggacaaccccaacggcaagatcaagcgcgatgtgtttatcggcgagccgggcgtcaaccaatacaaccgcgagcaatacgtgttgggctacgagctttcccatcgcctcaacgacgtctggaccctcaagcaaaacgcgcgctacgccgaggtcgacgaccgctacaccgcgccgttgcacggctaccgctttgtcgccaacccaaatactggggtgcaggaccaacgctatctgcagcgcttcggggtggactggtcgcagaccaataaagtgttcggcgtggacagcatcgcccaggctgagttcgacacgggcgcgttgtcccataccttcatcgtaggcctggactactaccattccaactcgcagtttcatggcttgtatgaccgtaacccaccggttatcgacctgttcaagccggtgtacggccagcgcctgaatttcggccaaccgtaccgctgggaccgcacgatcacccagaccggcctgtatctgcaggaccagatcaagctggataaatggatgctggtactcggtggccgctacgactgggccaatgtggtgaacaaagaaccgatccaggacacgcgcttcgccagtaaagaccaggccttcactggccgtgctggcctggtgtatctgtttgataacggcatatcgcccttcgtcagctattcagagtccttcttgccgctggccggcaccgatgcgaaccggaaaccgtttgagccgtccaccggcaaacaatacgaagtcggcgtgaagtaccagccacctggccaaaagagttttatccaagcctctgtttaccaactggaccaggacaatgtgctgaccaccaacccggtagacaccaccttcagtacccaaagcggtgcgatgcgctcgcggggtgttgaactggaagccaaggccgtcttgagtgacgcctgggaagtggttgcctcggcgtcgcgcaatgacatcaagtacaccaaggacaacgacggccgccaaggtcgccacccggccggcatttccccgctcaccgcctcgatgtgggtcaactacaccgtgttgggtgacacaccgctggccggcctgggtgcgggcctcggcgtgcgctatgcccgtcaaagcctgggcgactactacgaaggcgccttcaacgtgccgtcctacagcgtctacgatgcgagcctgcgctacgacctgggcgcctcgccgctcaagctcaaaggcgtgaaactggcgatgaacgtgcagaacctcaccaacaagacctacgtctcgcagtgcaccagtaatctggattgctactacggggaagggcgcacggtggtatcgagcctgacgtacgattggtaactaagcgtttacgtgatatttgccgcggtgcgcacccgtcaagggtgcgctctgttgccgcccgagatctttgtccctacaccaggtccgctgcaaatcgtgtacacacattggaaagcatgcgcacatcggcaccgctacagcctgccgcttcgaaaaagccggaggcttctcgcacgacggcatacatatccgtgacgatggatcttgcttcatccgcccccaacccaaagcgttcaggcgtactcagcaaattgctgacagacgataccctgccctcattcccgatgatcaacgcctgcaagcctagttgcgtggggtggggcaacacgtcaaatactggcgcaagggaatagcccgaggcgctggtcagcagaaccccggtttgtttcaggtggtcgtcgctattgccgatcagcacattgaaggccatacgcttgtaaagctcacgcatgtcaaaggtggcatcgtcgcagaccttcttcaacacgtcggcgatcctggaataggaaacggcactctcaaccgcgtcaacgcgcattcgcggcttctcagtgctgatcaacgaattgcagctgacatagtgctcgcgcccagccccctcatgccggtcaaaacgctcgaccatcaaaaccggtttgccggcgacctctaccaacttgtgcccggctgcgggtagacctgccgcatccgccatttgaaggctggcgaattcagcacgtggttgatcgaaaacatcgtcgctacggccgaatttagcaatccattccttaccttcgtgagtcacggtgaccttcggcctggcgccgcccatggaactgccgaattcgaatagtcgtgcgatttccgcaggcaggtcgacattacctttttcgacctgatcaaggcccaccatgattttctcaaggtcttcaaatcgcggcggttggtgcagagtcggcaacaggtttcttgacgcactgaacagcaggcagcccactcccgcaccccgcgaagcaaggagccattcaacttcgttttgtggatgctgtttgtgggtcgccagtagagcacgccgaccccaattgtcgggcgttgcgtcgtcgagcacaccaaacatgcgtgtcgaggaatactggttaggggtcagtggcaggctaagcgggtcaatcgcaaatgctttggggcgcgcaagccagctgttggcgtagcgaaaaacgaatccgcttgcgtgcatggccacctcaccaacagggaccggatcaccgactgagtgagctgaaaaaacgaatgcgttaccaatcggcttccaagacatcaggttccccttctgtgcgaattcggtcgggctcacgggcgaggctcatggtaatcccaacctggtcaagttctggtgacgcaatgctcgccataccttcttccaggtccatcgcgctaagcacattcatcagcacgccgagggatacgccggcctcgccctgtctcagccgctgatacgtctgtcgtgtaatgcccgcccggctgcatatggtcgagattttcaaacggcgacgaatgcgggctatttcgataccgttcccgatacctctcatcagttcagcgcttctctctgagatataccctttgtgggggtatggcttggctgtttcttgcatgatatatcaccctttaaagcagtagaggtaacttatatcatccaagtctctaaggccacctgcaaaaaatcggctcgatgctaaggctttttgtaggagctagcttgctcgcgaacaactcacaggcgccgcgttcaatcaggaaacacgcgttatcgttgacgtttttcgcgagcaagctagctcctacagagggcattaggctctatgcccggttttttgcagggttggaagactcaagggttctgcaaaaacaccacatacccgcgaaaccactcattaccccgcagataccccggctcttgccactccccaccctgaatcaggccaatcttgaacggcacgccgagccgattcatccgcggcaaatacgcggcgtaatccgggatgctgtgacggccctgatacgtctgcaccaccacttcatccactacgcctttgagctgggcgatggcggccgggtcggcgttgctgctccagtccattaggccggtgatgctcaaccgcaggtcggcaggcaggcgctggcgcaggtcgcgcagaaaatcggcatattcgtgcaggtattgggtgcgggcgtcgaagtcgatctggatgccaaccacagggttgccagcgtcacgccagcgttgcacctgaccgagcagttgggtgtagacctgttccggccagtgcaaggtgtgggcgcggtagaccacccagatttcgccttgggtaatgcgcggtacgctgatgccctgggcgatcagttgcacgccgcgttgcggcgcgcggcgagtagagttgatctggccctggaggatgtacagtgtccgggcctgcttgatcaccggctggggcgtgacaccactccacagccagaaagcgtcatagtcgcgggcgtcgaccgcaccgaaagccgggcctgccagcaacagcaaacccagccacagcgacttcaccagtagtactgcagcgatttgccccactgggtgtcggcgaaaccggtcttgagctggcggaaccaggctttgcgtaccgcgggcgcgacgtcttcgccaccgcagctgttgtagccggccggcgcgtagcaattgatggcgcggaacagtgcataggccttgtcggttttcggcgccttggcattggcgatcacctgtttgtagccgtccaggcgcgagaaggtttcacccttgaactgcgattcggtgctgcccaggctgccggcggcgcgggggtgttccaggggcatgccgtccaggccgttgcgcaggatgaactcaccgaagcagttcaaggcgtgggggtttttggcctcatcctgcaaggtcgcggcggtttgcgcgatgcttgggcaggcgtagccggattcggctttgtcaccgttccactggaacagcttcaaggactggccgctggtgtaggtgtagcccaggctggtgccgagcttgtcgtcagcgagcgaggcttgcttgaggtcatcggcaaaggtggcgtactggccgtgcagcaggtctttatagagcagcacgaattgcgcactctggcgctcggtcgggtcgctggccttggcgatctgctggcgcagcaggtcgggcccggcgacgttgcgcagcaggatgtagcgcacttgcttggcgctgatcggcgaatcggttgcgaacaccttggccagttggccgctgcgctcatagttcatcgccagggccagctccagctggtcgcgttgcaacggctgctttgccaggggcagcaattgcagccacagcgcttcggcgccttgccagtcttgcttggcttccagggccagggcgcgcagagtctgctgactgaaggcgaaatagtcgaggctcgacggcacgctgtcgggcaggtgcttcaaggcgttggagggctgatgctcgacatagagggcatacgccgcttgcaggtagtcgaacaaggccggctcgttggcgaaggtgctcttttgcttgtcgaggtcttctcggctcaggagcggcggcgtatgagcacgcatcgccatcaggtcgctgaccacttgcagcattgggctgttctgcgccttgttgccgaccatcagcaacttgaggtcagcttcttcgaccaactcgtcgacgctcacattgcgctgggcgtcggttgcctcggtaaattgccaggtaaagtcttcggcaagcttggcgtcgtcgttcgccagccaatgcacgcggcgcagcaggccacgggcggacgcaacgtaatcgccttgtggataatgtttcaggtaaccgagaaagccttcttcggcgtcgctcaaggcagacttatccacatgctcgcgttgcggcataccgtactcatcgaaggcttcggcctgggcccggttcaacgaggtgcgtgcggtcatgtacagcgcggtctctttcagccaaggcagatcgctggtcgcggcggcggcgaaaccgcgctcggcgtaaacgaagcgaccgccgtagaaatcggcggcggcctgcaggtaggtgcgaaacagctgggcattggccgagggcgtcaactgcgcgtccaccacctggcctgtgaagtcacaggtggtcagcaactgcaaccgcgctttcaccagcaagtcgcgctcggctggcggcatatcggctttgatcacctgactgataaacgccgtggcgctgtcatcgctgttgctgcggcagcggctgccttcgccattcaggaacgcttcaccggcagtcttgtattcctcgcgcttgatgcccagcggttggagcagggtgtcgagttcggccgtgcgtgaatcgtccgctttgttatcgggctcatcattcgcggccggcaccggcaccaggcgatacaccggaaacggcaccgggccgaaaccctgggccaaatcgtcttcgcccaaggtattgggcgtcagcggcgcggcttttttgtcggccagcagcaggcgcaggttgacccgactgtcgttacccgggctgagaaagggctggttgctgcaaggttcgaggctgtcacgcgagacacgccagtcggggtagcatgaatcgtcggagctggcctgagcctgtagggaaataccggccagcagagccagtgccagaggtgacaaaaaaccgatgcgcatgacgtgtccttgatcctgagtccttggagggccccaataatagcctgttctgagctgtgcttcggtgaggtcctacgcaaaataccgatttgtccgattccagcggcgaagcctgggcttttgtcctagagtggcggtgtttgcgctcaggcaagcgagctaatgccaggggtattgaagtgcgtcggtctgtggttgagcaaaacgaaaaagccggagcgctgccagccttgcagcgcctgacctggcaaagtgctggtcgactcagccgtctctggtgggtaccgatcctggcgctggccatggccctgcggttttatcacctcacctcggcggcgatctggggcgatgaagggtcgagcctgttgctcagtgaatacgccgtggccgacctgtggtttcacgcggcccatgatgtgcatccgccgctgtatttcttcctgctgcgcggctggatcgaagtgttcggcgacagcatcgggtccattcgcagcatgagcgcgctgccgggcgtagccgtggttggcttgggcatctggctgacgcggcaactgtccacccggcgcacggcggtgctggcgggcatcctgctggcgctgttgccgacggcggtgcgctacagccaggaagtgcgcatgtattcgctgctgggcgtgtggctactgggcgccacgctggcgctggtgtactgggtgaggcagcctgaacgcgcgcgttatttggctgtgtatgtgttgttgatgagcgccgggttctatacccactacttcaccgcgctgtgcgtattggtgcattgggcgtacctggggttgcaggcgccagttcaacgcttgattacgcggcctgcctggtgggtcgccaacgtagcgattgtgctggtgtatctgccctggctgcccaacctgctggacctggtgcagcacctggatcagcttaaagtcggcggcgacattggttgggaagatccggtcaatctgctgtcgctgccgtcgatgatctggcagttcctgctgcaggatgacggtcttggcatctggccgccgctgttctggctgttccccctgctgctggccgtggtggttgtgctgaccgcctggcgcaatcgcccggcgcgcctgccggcattgttttgcctgctgccgctgctgctggtctatggcgtgtctttcatctcgccggtgtttatcgagcgttacctcacggtgtatgcgttgggcctgccgatagtcctggcgcttgccatcgaccgtttgccgtcccgtttttcctggctgggcgtggcattgttcgcactgtttgttggcgtagaactgttggggttaaagaacaacttcgaggtggatgagcacgaccagttcaacgtgccggtggagttcgtcaatcgcaactaccaggaaggcgaccgtatcgtcctcagtgacatgatgtggtacctcagctacgtgtattacgaccagaccgacgcccaactgcagctctacacgccgcccaaacccgacggcgctgccactcgcccgaacgcctatggtttcggcacactggtggaccaggacggtggccgcatctatctggaccgcctctcagcactgcccgctcaaacgcgccgggtatggttgatcagcagcaacgaagccccggatgaattcgcgccactgcccaacggctggcgcgaaatcagtcgccaggatggcggtggcgccagggcgcggttgttcgtgctatgcaacgcaccggcgccgcaacctgaaggctgccgctagactcacttcaacctacttatgaggagccttccatggaatcgccagtgcacagcctaccggctttgttcaaacagcttggcttgccggacgacccggtcagtatcgagcaatttgtcgcctctcattcgccgctcaagccggagttgaaactcgcggatgcgtttttttggacggagagccagagggcgtttttgcgtgaggagattcgcgacgatgcggattgggcggtagtggtggatgagttgaatctgatgttgcggggtggacgacgggtgtaaaaaaatatcccaataaaggcgagcatgtaaaaaaaatggtgagcggtaaaaaaaactgggctttaatcgcttaagtgaattttttctggaaaagctcgccatgccaacagtcggatacgctcatctgtgtgaggcgctggatctaaaggttatcgcaccgttgcgcgctgcgatgatcaagccggtgaccaggattaccctgatcggtgactgcctggcggtgccccattctgtggcgcctgcccaacatgcgctgtttgaacatgtgctgtttgcgcttaagcatgaaggcgtgaacctggcgatacttgcccaggtgtttgaacagcttggcccagaaccatttttggcggcactggctggcgcgcccaacggtgcgtttatccgaaaagcctgttttctttgggaaggctttaccgggaaaatgctggatcacacccttcctgttcgtggtcgcgttgttcccttgttcgatccccagcgctatgtaaccggtccgagcattcgcaacagtcgttggcgagtggatttcaatggtttgggctctttgcattattgcgccaccgtagagcgaacgcctgagctggaagcgttgttggcgcttgatgtattggctcgtgccaaatccttcatggccaccctcccttccgaaatgatggaccgcgccatccagtgggcatacctgcacgaaacccgcgattcatttgccatcgaaaaagaacaacccagcgaagaaaaatcccgccgcttcgtccaactcctgcgccaggcccacgaaggccggttgctcaccgaggagtacttggtcgagctgcaaaacagcaccgtctccaatccctttgacaaagccgtcgcgtttcgccacgaacagaaccatctgcacaacgggctgcgcggcgctgccggtgtgagctacgtgccgccagttcccgcgctttgccaggaactgatggaagagcttatggccttcgccaaccagcccgtgcgggacgtcgatcctttggtggcggcggcagtcaccgctttcggctttgtcttcctgcacccgttcatggacggtaatgggcgcctgtctcgcttcctgattcaccagacgctttgccactacggcgcactggaaaatggcttgttgctgccagtctccgtcgccatgaagcatgaagagcaagcctacctggaggcactcaagaccttctcccaacccatgcgggaattctggaacgtcacctggctggacgccgaccacatggcgttcgacttcatcggccacacctcgatctaccgctactgggacgccacccgctgcgtcgaattcaccctgcaaatggcccgccgagccctggaagtggaactgcgcgaagaaaccgaattcctcgaccgctacgaccgtgtgatcaaggccgtgaaccaacgctacgacgtgcgcggcagtgagttgtcgaagctggtgatgatgtgcctggataacggtgggaagctttcgaagcatcggcgtaagcagtttcagtacagcgtgtcggaggaggtgtttgggtttattgaggaggaggcggggcgtgctctgcgcgaaatcgggaaatttcctatcgactaaacagaaacgggcgatagctgccagcgtgaggagatcgttattaacaggtgctggctacctgttctggacacaacatgaaactgacgcgcatgcatgttttttggttttggggagccatggatgccctttatctaattcggtatacagtagcaagcgcaatggagggaaggattccctatttaagtgatattgaaaatgctttatgggtactgcgtgatcacagtcgtgagcagttatacatgttcggcattgccatgctgctgcaagtttcgatcctgatctcctgcgtactgctcttcctcggacatgagcaggtgaggtgggttacttaccttcaaacacccttgcgattggcttttatcgtgccttctgtttcgctgttgctggtaggcgctcagcttgttcctaactacaacctggtgttgatggctgtgctagtggttatctctgaagtcgttaaggtctggagcgtatggcgttggtgcaaaaaatcctgaccggccaataggcttggcaaccaaaactccatcatctaatcacgtgcgcatgggtctcgctgcgcaatggccaggacatgatgggcgaaacccagcgtcgcctggagggtcaggctgaaaaatagcccccacatccgacgctgatccaaatgtgggagggggcttgcccccgatgagggcgtgtcagtaaacgcatctgtgactgacccatccacatcgggagcaagccccctcccacattcgtcctgcggtgatgccgctgaatcgctccatccatcgagaaattgtttcaaaacttgacgacgcctcatccctccaccatattaatagttagcaaactaactgtatgcgaactatccagtgcctcaatccctcgaacaactccagatgaacctcagcagcagcatggtggtgggcgcccgtaactggcgcaaaatctgccagaccacgctggtgagctatggcatctccgaagcctgcgccgtgccgttgttgatgatcggccgcctgggagacggtgtgcaccaggtcaaagtagcccaggcctccggcatggagagcccgtcgctggtgcgcctgctcgaccggctgtgcagcgacggctatgtgtgccgcgccgaagacatccacgaccgccgcgccaaggccctgagtctcaccgagcgtggccgtgagctggtgcaggcggtggaggcgcaactggtgcgcctgcgtaacgaagtcctggcggatatcgccaccccggatctggaagccgcattgcgcgtgctgcgggccttcgaggcggccgaggctgtgtcatcttgagcggattttttaccggtttcccgcctgcccgcgactggttctatggggtccgtacattcgctgcgtcgatgatcgcgctgtacatcgccatgctgatgcaaatgccgcgtccgtactgggcgatggccacggtgtatatcgtctccagcccgtttgttggccccaccagttccaaggcgctgtaccgcgccatcggcactttcatgggcgcggcggcggcggtgctgttcgtgccgatgttcgtgcagtcgccttacctgctggtggtggtgatcgcgttatggacgggtaccttgctgttcctctccatgcacctgcgcacggccaataattacgccctgatgctggccggctataccttgccgctgatcgccctgccagtggtggataaccccttggcagtctgggatgtggcggaggcgcgtaccgaagaaatcttccttggcatcgcggtcgcggcggtggtgggcgcaatgttctggccacggcgcctgatgccggtgttcgatggctcggtggccaagtggttcagcgacgcccaggtctacagccagcgctttctcagccgcaaggtcgacccggaagaagtcagcaacctgcgcggcggcatggtcgccaccttcaacacccttgagttgatgatcggccagttgccccacgaaggcgcgcggccgcaaacggtgcgcaacaccaaagaactgcgcgggcgcatgattcacctgctgccggtgatcgacgcgctggatgacgcggtgtatgccatcgaacaccgtgcgcctgagtttcttgatcagctcacgccgctgctggaagaggccaatgcctggctccaaagcaccaccgaacaagcgcccttggatcgctggcgcgtgctgcgcgacaagatcgacgccgcgcaaccccaaggcgaagcgctggatgaccgtcacacgttgctgttctccaacgccctgtaccgcctgggcgaatggatcgatctgtggcaagactgtcgcagcctgcaagccgccatccagtgcgaaagccaggacacctggcgcgccgtctaccgccactggcgcctgggccggctcacgccgtttcttgaccgtggcctgatgttctactcggcgttttccaccgttaccgcgatcatcgtcgcctcggtgctgtggattctgctgggctggaccgatggcggcagcgccgtgatcctggccgccgtggcctgcagcttcttcgcctcgatggacgacccggcgccgcagatctaccggttctttttctggaccgccatgtcggtgctgttcgccagcctgtatctgttcctggtgctgcccaacctgcacgatttccccatgctggtgctggcttttgccgtaccgtttatctgcatcggcacgcttaccgtgcagccaaggttctacctgggcatgctgctgacgctggtgaacacctcgtcgtttatcagcatccagggcgcctatgacgccgacttcctcaacttcgctaacgtcaacctggccgggccggtgggcctgctgttcgcgtttgtatggaccttgatcgcccggcccttcggcgcagaactggcggccaagcgcctgacccgtttcagctggcgtgacatcgttggcctgaccgagcccgcaaccctgaacgaacaccggcacatggccgcgcaaatgctcgaccgcctgatgcagcacctgccgcgcctggctctcaccggccaggataccggcagcgccctgcgcgacctgcgcgtagcgctgaacctgctcgacctgctggcctactcgccgcgcatcctcggcgtgccacgggtgctgctcaaccaggtggtggaaggcgtgggtggttacttcaaggcttgcctcaaggcgggtgaacgcttacccgcgcccagcggtctgctcatgaccctggaccgcacgcgccgcgccctcaacggccagggcctgcaagacgaagacgatacccgcctgcacctgctgcatgccttggccggcctgcgcctggcgctgttgcccggcgtggaattcattggcggcacggaaatggaagcgccgctacccgatggagcgcctttatgatcggtgatctggatatcagcggggtgttcctgcccacgctgctggtgctgatgggcattacctatgtgttgtttctggtggtgcacgggctgttgacgcgcatgcacttctatcgcctggtctggcaccgggcattgttcaatgtggggctgtacgcgctgttgctgggcgcggtggactcactcagtcgatatttgatgacatgaaaaaaccttttttgactatcggccgtgtcgtcctgacgttgttgatcgtgagtttcgcggtcgtcgttgtgtggcgcatggtcatgtactacatgtttgcgccctggacccgtgacggccacatccgcgccgacatcgtgcagatcgccccggacgtgtccgggctgatccaacgcgtcgacgtgcgcgacaaccaattggtgaccaagggccaggtgctctttgccgtcgaccaggaccgcttcaagctggccctgcgccaagcccaggccgccgtggctgaccgccaggaaaccctggcccaggcccagcgcgagtacaagcgtaaccgtggcctcggcaacctggtgcccagcgagcaattggaagaaagccagtcccgcgtggcccgcgcccaatcggccctggccgaagcccaggtgacggtggactctgcccaactcaacctcgaccgctcggtgatccgcagccccgtggacggctacgtcaacgaccgcgcaccgcgcacccaggagttcgtcaccgccgggcgcccggtgctgtcggtggtggacagcaattccttccacatcgacggctacttcgaagagaccaaactcgacggcatccatgtcggtatgggcgtggacatccgcgtgatcggcgacaacgctcgcctgcatgggcatgtacaaagcatcgtcgccggtatcgaagaccgcgaccgcagcagcggctccaacctgttgcccaacgtcaacccggcgttcagctgggtgcgcctggcccagcggatcccggtgcgcatcgcctttgatgatgtgccggcggactttcgcatgatcgccgggcgtacggcgacggtgtcgatcatcgacgacaaagttaaagacggggacaaaccatgaagcggcttctggcaaccgcttccctggggttgttgctgtcggcctgccaagtggtaggcccggattacaaactgccggaacaggccgcagtcaaccgtggcgacctgcaagggccgatcatgggtgagggcagcaacgtggtctcggcgccggtgccggctgactggtggaagctgtacaacgacccgcgcctggaccagctggtgcagcaggcgatggcctccaacaccgacctgcgcgtggccgccgccaacctgcagcgttcgcgttaccaggtgcagcaagccgaatccgctggcggctggagtgccggcgccaaggctgaggcccagcgcttgcaagaatccggcgaagcgtttttgctgccggacaaagtcccggtcggcaatatcggcagcgtcggtatcaccacttcctatcaattcgacctgttcggcaccttgcagcgcggcatcgaaagcgccaaggccagcgccgatgcaacccaggcggcagccgatatcgctcgcatcaccctggtggccgatgtggtgcgttcctacacccaggtgtgcgcggccaacgaagagctggcgattgccaaccagtctctcgacctgcaagcccagagcaccaagctgacccagcgcctgcgcgatgccgggcgcggcgatgaaacccaggtgacccgttcgcaaacccaatacaaatccctgcgtgccgagatgccgcgctacgaggcctcgcgccaggccgggctgttccgattgtcgatgctgctctccaaaccggtggaccaactgcccgtcggcaccaatagctgcgccgagctaccgcacatcgctcaactgttgccggtaggcgatggcgccacgttgctcaagcgccgccccgatgtgcgccaggctgaacgccaactggccgctgccaccgcgcgcatcggcgtggcgaccggcgcgctgtacccggatatcagcatcggcgccacggtaggcaccgtgggtctgctggaaaacctcggcaccccggccaccaaccgctggggctttggcccgatgatcagttggacggtgccgaccaacggcgcccgcgcgcgtatccatgaagccgaagccgcgacccagggcgccctggcccacttcgacggcgtggtactcaacgccattcgcgaaacccagaccggcctggcgcaatacaccgccgtgttgcagcgccgcgacgccctggccgaagccgaacaatccgcgcggcaggcagcggaccagacccaccgcttcttccaggccggccgcgaatcgttcctggccgacctgcaagccacgcgcacctacaccgaaatgcgcgcgcaactggcggcggccaacacccaggttgccatgagccagatcgatctgttcctggccttgggcggcggttgggaaagcggacgaacgcaaggtacaaaacccggcaaaccgtgaggtgattgctatgctttgtcaggggaggtgccgtgacgcttcacccgacaaagtttgcgtttgctcatggggattccaataatgaaaaacccttatgctcccgctttctggtgcgtgctcttcgcactggtcctgttatcggccgcgtatttctatggcgtcatgctcgcccatcaactcgacaaggccatggtgttcctcgacagcgcctgcctggtgatcggcaccttgtccatcggcgtcgttgcctgggcctcctaccaaaatcaacgggtgaagaaaaagctcctcgagcaaggcaagacccgcgtcgcgatctgggacaccaaggtcgccctgcgccgggtcgaaaccgtgttcgaccgctatttctggggcagctactggcagcccgggcgcaccttccaggaagtcatgggcgatctcaccggcaccccgctggaaaaaagcctcgaagtcctgaaaaaacaatgcgtgctgctggatcgacaggtagccgacggtaggcactggctgaataacgcgcgggaattgtccgatgtggccacgcaaatggcccgtgagcgctatcagctggatttctgcgaccccaaggccgacactcccggcaatgccgtgatacaccgcgagtttgaggtgttggtgtacacctggaccgctcgcttgaagagttttgatcaccagttggatgaaattgagctggagtactcctgaaccatgcctgaactgatgcctctgaaaggttgggccgtttgcgcccgccagtgctaatcttccccagccttcggccctacgggccactactgtaggagcgagcttgctcgcgaaagacgtcaacgataacgcgtgcatcctggataaacgcgttgcctatgcgttcttcgcgagcaagctcgctcctacaggaaccccgtcggggttcaaggaagacagcccacttctcacaggatttgatcaggtcacttcatgaataagccagccgttgttttcttgggttttgttgtcgccatcggcgccgtcagtgcgggcggtgcctggtacaccggcaagcaactggagccggtcctgcagaccgcgatccagaacgccaacaaagaactgcagacctccatggccggcgtcgacggcaccctggccctggagctggtgtccctggaccgtggcgtgttcagcagcactgcgcactaccgcctcaaaggccagggcagtgtgttcggtgaagacaacccgaaccccgagttgctgttcgtcgaccacatcgagcacggcccgctgcccttctcgcgcctggtgaccctcaaatggctgccggtcatggccaccagtcactacgaactggaaaagaaccccaccacggaaaaatggttcgctgccgccaaagacgtgtcgccgctcaaagacgtgtcgccgctcaaaggcgtggcgaatatcggctatagccgctcggtcaccggcaacatcgaactgctgcccctggagttcaaggacgacacctcctcggtgagcttctccggcgccaacctggatttcgacagcagcgccgaaggccagaaggtcaaggctgacggtttcatgaacagcctcaaggtcgccgcggtggatgccaatggtgcaccgttcgaagccgagttggccggcctgaccgtggccagcaacctggagaaatccaccttcggtttctacaccggccagaacaccgtggagctgaccgacaccaaggtcaccttcggcccgcagaaagccgtgttgaccctcaagggcttcgagcagaaagactccacccaagccaaggacaacaacctggccggccgcgtcgactacaagatcgacgagatcggttaccagggcaaacctgtcggttcggccgccatggccgtgagcatgaagaacgtcgatatcccggcgatgctggtgctgaccaagctctaccaggacaagatgcaaccggtgcaagccgcggccgctgcgggccaaccggtgccggaactgcaattgaccgaagccgagcagaccctggccgaagccaatgtcaaccaggtgctggccgccaagccgcaactggcggtggaaaacctgtcgttgaaaaccacccacggcgaaagcaaattcaacctggtggtcgacctggccaagccaacttccatggaactgccgccggttgaactgggcaagcaaatggtcgcgctgctggatgccaacctgaccctgtccaagccgatgatcagcgacgtggcggccctgcaagcccaggtcggtggcgtgactgacccgaaggccatcgagcagcaatcgcagatggcggccgagatggtcagcagcatggcggtcggcacccaattggcgaccctggtgggcaccgatgtggtttccaagctgcactacgccaacaacgaagtgaccttcaacggccagaagatgactgttgagcagttcatcagctttgtgatgtccaaggtcggtgcagtaagcggcgcccagtaagcgttgaaaatgcggtaattaatgtgggagggggcttgctcccgatggcggagtgtcagtcagtatatttttactgacccaccgctatcgggagcaagccccctcccacatttgtattcgtgcctggcaagaaatctctgtcagccaattctgaacaattgttctgaattgcccttcccctgacatcgctaagggatagttcgcccaggaaagctaggtcgggtcccgagacgccgacaccctgatgcacaacgctcaggatcacccatcgttgcagctttccttgtaaggaagccgacgacatgttgcgaatccatccactcagtgcatcaggccagttgcgactgctcattggagcagccttgtgcggcccattgctgatgccggcctatgccgtggctgaccctgcctacgacgccctgatcatccaggcccgcaacggtcacttcacgcccgccttgacccagttgcgccaactgtccgccgaacgccagagcccaggccaggtcagcgaccacctggtgatcgccggctgggccgggcaagacgccgaagtgctgaaggtgtacgaggcacaaggcaagtatcgcaacctcaccacccaggcgctcgccacggtagcgcgcacctatcgtaatcaaaagcagtgggcccaggccgaggcggtctatcgccaggcgttgctgcgtgaaccgaataacgtcgacctgcaactgggccaagccctgacccaggccgatggcggcaaagccaatgaggcggtgcaacgcctgcgcacgatggtggcggcgcaacccaacgaccccaaccgccgcatggccctgggttatgcgctgacgcgtgccggcttgaactacgacgcgctgttcgagttcgaccaagcctttatccgcgccggcgacaagccggaagtggcccgtgaatacatcgtcgccctgcaaaaggcgcgtatgccggagcccgccctgcgcctgtcggccaagcgccccggcctggtggatgcggttacccagcgccgcctggaaggcgacctcgccgccgagcgcgtgcgcatggccgagttcgccacgcgtactgagaaggagcgctatgtcatcgctgatcgcgccctgcaggattacgacaaattgatcagccgctggggcccggacgcctctgcccacgacgacgtggtgggctggcgtattgaccgcctgggcgcgctcaaggcgcgggcgcgcacggctgaggtgatccgcgagtacgaaaccctcacggccgagggcgtgcaattgccgacctatgccgtgcgctgggtggccgcgtcctacctcgatcagcgcctgccggaaaaagccgcgccgctgtaccgccaggcgctgaccgcagcagacgccgacgttggtgatcacgtcaaagacagcactgctctgttctacgccctgttggaaaacgaccaggtggatgaggcgcgtgcggtcgccacgcagctggcaagcaccgagaagcctcgggtcgaactcaagggcctgcccattggcaaccccaacgacgagtggatggacgcccagcaattggcggcccaggccggcacctatggggctgacctggatgccagcgaacagagcctggaagacctgggcagcaaagcccccggcagcatcggtgtgcgcctggcacaggcggaaatgtaccgggcccgtgaatggccaaggcgcgctgaggactccctcaaggagactgaaaaccagagcccccgtgacatcggtgtagaaatgtcccaaggcttcaccgcgctggacctgcaggaatggcggcaactggatctgctcaccgatgacgtcgtcgcccgtgccccggacaaccgccaggtacagcgcctcaagcgcctgcgcgatgtgcacgacatggccgaagtgcgggtggaagcctacaccggtaaaagcttcggtggcggcaataaccaagaagccggcgcggtgtcgggtagccgtgactggggcatagaaagtgtgatctacaccccgcccatcgacgaagactggcgcgtgttcgccggtgtcggctatggcactgccgattttgccgaaggcaccggccatcaccgctggcagcgtgtgggtgtggagcggcgcacccgtgacatgaccatcgaagccgaggtatccaaccattcctatggcgatggctcaaagcaaggcgcgagcgtgtcgatcgcccgcgacatcaacgaccactggcagtacggcggcagccttggctatctgcttaacaccacgccattacgggcgttgaatgatggggtcacggccaacggcggcagcggttttatccgctggcgcgcgaatgaaagccgcgagtggaaactgactgtcagcccgtcccatttcagtgatggcaacgaccgcgtcgaggccttgctcacgggccgcgaaggcatctatagctcgccgaaagtacaagtggagctgggcctggacgtcggtgccagccgcaacagcaaggaagacaccatctacttcaaccccaagtccgacttcagcgtgttgcccaccgttaacgtcaaccatgtgctttatcaccgctacgaaacccagtggagtcagcagttccagatcggcgcaggcacctatagccagaaggattactccaccggtggcgttggcttgatcggctacggccaacgctttcgctggaatgacgtgctggaagccggcgccaacctgagcctggtcagccgaccttatgacggcgagcgcgaacgtgatctgcgcctgctcctcgacctcacttaccgtttctagaagagcctgaccatgaccctcctcagccgttgctttctggtcctgggtgtaatgctggccgccgcctgcgcccagcaacccgcgccattcgttccacctgccgagcggccgatactggccagcgaagcgccgtggccgaagaaccatttcctgggcattgcctaccacgacgtctcggacaacgaccccgaccaggccgtggtggcggtgcgtaccgaacgtttgatcgagcaactggcctggctgcgagagaacggctaccaggcggtcagcgtcgaccaagtcctggccgcgcgccggggcgggccgacgctgccgcccaaggccgtgatgctcagcttcgatgacggctattccagcttctacacccgcgtgatgccgatcctgcgggcctacaactggcctgccgtgctggcgccggtgggcagttggatcgatacgccgctgaaccagccggtggacttcgccggtacgccacgggcgcggggcgacttcctgacctggcagcagatccgcgaagtgtcccagtcgggcctggtggaaatcgccgcccatactgacgccaatcacaagggcattctcgccaacccccagggcaacctggagccggccgccaccacgcgtcgctatgacccggcgacccgtcgctacgaaaccgaagcacagttccaggcacggatgcgcacggacgtcgcggccatctccaacaagatccgtaccgtcaccggcaagtcgccgcgggtgtgggtgtggccttacggcgcggccgacggcaccaccctggccgtggtgggtgaacacggctatgagatggcgctgaccctcgacgacggcctggatgattcgaacaagctgatgaacagcccgcgcttcctggtggcctccgacccggatggcgaacacttcgccagcagcatggtcgcggtgcaggccaaggcgccgctgcgcgtgctgcacgtggacctggatcatgtctatgaccccgacccggtccagcaggcgcacaatctcgacgtactggtgcagcgcgtggtggatatgggcgctgtcaccgtgttcctgcaagcctacgccgaccccaagggcgatggcctggtgcattcgctgtacttcccgaaccgccacctgccgatgcgtgccgacctgttcaaccgtgtctcctggcagctgcatacccgtgcccacgccagcgtgtttgcatggatgccggtgctcagtttcgccctcgattccaagctgccacgcgtcacccgttgggacccgcaaaccggcaaggtcggcaccgatccggatcaataccagcgcctgtcacccttcgacccaaaagtgcgccagatgattggcgagatctatgaagacctggcgcgcaccagcaacagtgccatcgacggcgtgctctaccacgacgatgcgctgctcagcgactttgaagacgccagccccgccgcactcaaggcctacgccgcacagggcctgccggacaacatcgccgcgctgcgtgccgaccctgcgctgatgcaacgttggacgcgcttcaagagccgctacctgatcgacttcaccaacgagttgaccgtcaaggtccgtgctattcgcggcccgcagatactcactgcgcgcaatatcttcgccgagccgatgctcaaccctggcagcgaagcctggttcgcgcagaaccttgatgacttcctccagacctatgactggacggcgcccatggccatgccgttgatggaaggccagtcgctcaaagactccaatgcctggctggaaaaactggtagccacggtcaaggcgcgccccggcgccctggataaaaccatcttcgagctgcaagccaaagactggcgcaccaaggccgcgccggatatcagcgctacgcaattggcgcaatggatgggtgtactcaaacgccagggcgtcaccagtttcggctactacccggacaacttcctggagaactccccggacttgaagaccatacgtccggctctttccaaccagtggaatccttagatcatgatcgacagaatcctggctatattcgtcttggcactggtgttgggcttgcccctgggcctgatcttcctggtgaccgggcagttcctgatggacttcgtgttcttctacccgctgttcatgtcggcgctgtggatcgccggtggcctgtatttctggctgcactgggagcgccattggccgtgggaagcagacacgcctgcgccgaccctggccggcgagccgctgatctcgatcatcattccttgctacaacgagggcgataacgtcgctgacaccatggcggccgcattggcccaggtgtactcgaatatcgaagtgatcgccgtcaacgacggctccagcgacaacaccgccgcagtgctcgacgccctggcgctgcaacacccacgcctgcgcgtgctgcacctggcgcagaaccagggcaaggccgtggccttgcgcatgggcgcagtggctgcgcgcagcgaatacctggtgtgcatcgatggcgatgccttgctcgacaaaaacgcggcggcctacatggtcgcgccgatgctcgacaacccgcgcctgggcgccgtcaccggcaacccacgtatccgtacccgctcgaccttgatcggccgggttcaggtaggcgagttctcctcgatcatcggcttgatcaagcgtacccagcgggtgttcgggcgaatcttcacggtctcgggagtggtggtggcgtttcgcaagaaggcgctggaccgcatcgactattggagcaccgacatgatcaccgaagacatcgatgtcagttggaagctacaactggatcactggtcgatcttctacgagccgcgtgcgctgtgctggatcctcatgcccgagaccgtcggcggcctgtggaagcagcggctgcgctgggcccagggcggcgccgaagtattgttcaagaacatccgtggcatctggcaatggcgccatcgctacctgtggccgctgctgttcgaatactgcctgtccaccggttgggcctttaccttcctgctttcggtggtcttctgggccatggggaaattcgtcaccctgccggcggccattaccgtggactccctggtgccgcccgcgtttaccggcctggtgctggcgatggtgtgcctgctgcagtttgcggtgagtatcctgatcgaccggcgctacgaaaaagacctgtggaaaaccctgttctggaccgtgtggtacccgatggtgttctggctggtgagcctgttcaccacgctggtgagttttcccaaggtgttgttcaaccagcatcagaagcgcgcacgctgggtcagcccggatcgcggaattaaacctgccgcagaggaggcgtgagcatgaaactggtcagaactcgccaaagccctgtgatgtggatcatcgatgtgttgctgaccctgctggcctggggcgggctggtctggttgctggcacgtggtatcggcgccatgctcgaaacccatggcggcccgcgcatcgaagcgccgatctttgccgcgctcaacaccttgcagatctacctgtggatcgccttgttcaatgcgttgatcctgatcggctgggcacgctatcaacaacgccgcggccgccagtttgcccagcgccgcgccgaggccaatgccctgagcgataagcacttgagtgaaagcttcaacctgggcgatggccacctggagcagtttcgcaaacccggcgtgctggtgatccacaataacgaggagggcggtgtggaagacgtgaagtcccatgtctctcgcgacgtcgaacgccccggcctggccctggtgcccggcactgacaaagacaagggcattggctgacctaggagtacccaatgtgggagggggcttgctcccgatagcagagtgtcagtcaccctatatatgactgacacaccgcgatcgggagcaagccccctcccacatgtaagatttccagcccattaattgcagtggttcagccccctccctggaattccgataaatgggatccaattcacaaaaaccccgcgaacttttctcccttcctcggtactaacctatctcgacgaaacttgatggctaaataatggcaatcaaaaattcattcgtcaaatcgccatcaaaatagtcgccacttgtcggaataatcactccgtgtgcccggccaagactcttttgatgaaaatttattattaataatcaataggttaaaagactaacccatcgaaagacccaacttcgccagtttctaggctagcgggaagttcgatgttagtttgccggcccttgattttcgatggatcgaacatgtcctcactattgccacggactcggtttcttgtatgcgccttgctcacttgcctgagcctgaacagcgcattcgccgcccccacgcctggtgaccaggacctgatccgcgaccggcaaaaccgcctgctcgaagagcaacagcggcgcctccaggaactccaggacctgcccggtaaagcggacaagccccaagccccggcaacgcccgccgacacccgctgcttcccgatcaaagacattgagctcaaaggcgccgacagcctgccggcctccgaccgcgagcgcctgctcaagccttatatcggccagtgcctgggggtgtcccagctcaacgaactgctcaaggccatcaccgactactacctcggcaaaggccgcgtcaccagccgcgcctacctgccgcaacaagacctctccagcggccacctgcaagtgctggtggtcgaaggcaagctcgaagccctgcgcagcgccgaaggtagcacagtgaccgagcgcgaactggccatggcctttcccggcaaggtcggcgaggcgttgaacctgcgcgagatcgagcaactggtggaccagctcaaccgcctgccgtccaaacaagcgcagatggaactcacccctggcaagcagatcggcggtagcgacgtggtggtcaagaacactgcgcaaaagccctggcgcgccagcctgtcgcgcaataacgacggccagaaaagcaccggcgaacagcaatggggcgccggccttgagtgggacagcccgctgggcctgggtgaccaactgatgttgcgcggcggccacgatgccatgagcgaccaccagaaaacttcgaagaacaccatgctctactacaacgtgccgtggggctggtggaacttcagctacacctacagcgaaagcgactaccgcacctacggcaggaccgacgactacaaatacaagcaggacggcgacaaccagaaccaccaactgcgcgccgagcgggtgatccaccgtgatgacgtgagcaagacctcggtcaacgtcggcctggcgcacttgcgcaccaacaactacgtcctcgatgtgcgcaccgcgcccagcagcaaccgcctcagcgaactgcaactgggcatcaaccacgggcggcgtatcggcaatgccttcgtcaacctcgacctcggcatgcagaacggcatcggcttgttcgacgctcagtctcaggaagagcgtgactccatcggtcggcgccagccgaattcgcgctaccgcaaatacaccgccaccgtcagctacctgcaacccttcagcctgtggggcgagtcgttcagcttcagcagcctggccaccgggcaacgcagcgaagacccgctgttctcgccccaacgcatgagtctcggcggctccgcctcggtgcgcggcttcaaggaccaactgctgaccggcgacagcggcggctactggcgcaacgaagtgcgctgggcgcgcccggtgaccctcgactggatgcgcccggccttcttcgaatacggcgccagcgtcggttatgaccagggcgtgatccgcaacgaccgttacaacgacaacgtgcatggccgggtgtccagcaactcccttgagctgttcgcccgcggcaaaaacgtcagcaccagcgtgacctttgcccactcgctggaaagacccggtgtagtcaccgagcgcgaagcgccgatctacttccgcatggatttcttcctgtaattcaacgccccgctgcacgagaaactgacaatggatgttcgccaatttgccttcctggcccgccaaccttctgctgccctgaagccgcggaactcgttcttcggcctgcccaagcgcgggctcgtgctgatcctggccaatgcgctgttctggcagccgctgctggcccaggccgagggcatcgtggtcagcgcgcccggcaccaccgtgggtgcggcgggcaatggcgtgcccgtggtgaacatcgccacgcccaatggcgcgggcttgtcccataaccagttcaaggactacaacgtcggccccaatggcgtaatcctcaacaacgccaacggcgccatggtcaacacccagctgggcggctacatcgtcggcaaccccaacctcaagggcggcgcggccagcgtcatcctcaacgaagtcaacggcggtagccgcagtcagttgcgcggctataccgaagtggcggggcagtcggccaaggtcatcgtcgccaacccctacggcatcacctgcagcggttgcggctttatcaacaccccgaatgtcaccctgaccaccggcaaaccggtgatcgaccagaacggccagctgcagcgctaccaggtcgatggcggcgccgtgaccatcgacggcgagggcttgaacgccagcaacgtcgagcgcttcgacatcatcactcgctcggccaagatcaacgcacagatcaacgcccgcgaactcaacgtgatcgccggccgtaacgacgtcgatgcgcaaagtctgaaggccaccccccgcgccgacgacggcagcgccaagcctgagctggcgattgactcctcggcccttggcggcatgtatgccggcgcgatcaaactggtgggcaccgaagccggtgtgggcgtgaagctcgacggcaccctggcggccagtggcggcgacattcagctcgatgccaatgggcgcctgagcatggcgcaaacggtagccaccggtaacgtcaaggtcactgcgcaaaacgtcgaccttaccgacaaggtctacgccaacggcagcgtgcaggtcaccagcgcccaagccttggtcaaccagaaaagcgtggccgccggccaacgcatcgaactcaacgcggccacgctgactaacgctggcatcatcgaagccggcgttgcccccgacaacagccgcaacaccaccggcgatctggtggtgaatgcgcagaccgtcaacaccagcggcaacctgctggccagccgcgcactggcgatcaccgccgcacaggcgctgaccaaccagggcgcgatcatccaggccaagaccgtcgaggtcagcagcgccaaactgaccaaccagggcgccaccgcacgcttgttcggcgaacaaagcctggcgatcagctcaccggccatcgtcaacctcggcggcctgattcgcttcggtgaaggccaggccgccacgctcaacagcgcctccctggacaaccgccagggccgtatcgaaatggccagtggcagcctggtgctgaccagtgccgacctgaacaacagcggcggccaagtcattgccaacgacctgacggtcaacgccggcaagctcaataaccagaacggcgtgctggtggccaaggccgccaccgtcaatgccagcgacctcgacaacagcctcaagggcctgatccaggccgacggcggcgcgctcaacctcaccgtcaccaacggcttcaacaatgcccagggcttcgcccaggccagcactgacctcaacgtcagcgccggcaccctcggtagcaatgcaggcggcgtactgagcgccgacaccggcaagctgaccctcaccgccgcgcaacagctcaacaacgcccagggccgcttacaggccgggcagggcaatatcgaactgcacgccgcgaacctggataaccagaacggcgtgatcgtcggcaaacaactgctgctcgacgtggctggcggcgatatcgacaaccgcgccgggcgcgtgttgggcgaccaactcgacgtgcgcgcttccggcctcgacaaccgcaacgccggcctgctggccggtggcgcccagggcgtaagcctgctgctcaaaggcccgggccagttgctcaacgcccagggccgtatccagagcgagggcctgctgcaactgcaaggcgagcgcttcgacaacagcgccggcatcctgttgggccagaccatcgacgtcaccgcgcagaccttcaacaacagcaacaaaggcgcgctggtcagcgatggcggcgacttagtgctcaaggtcagcgacctgctgaccaacgtcggcggccagatcgacgcgggcgaaagcagtgtgttggtcaagcaactcaccaccctcaacaacaacggcggcaccctgcgcggcaagcgcctggacatcaccgcccagcacctgaataacaacgacgacggccaactgctggccggcgccgggggcttgaactacagcggccaggatgtgagcaaccgcaagggcctgatcctcagcggcggcgccctcaccgagttgcacaccaccagcctggataaccagggcggcacggtgcaaggcgacagcctgaccgtcaccgctgacagcgtgaacaacggcagcggcggcctgatggccagcctggtcggcaacctgcaactgaccgtcgaagccctcgccaaccgtggcggcaaactgttcggcaaagaacaagtgaccgtcagcggcgccagcctcgacaacagtgcgggcggccagatcagcggcaaccagctcaacctgacttcacgcgccactctcaccaaccagggcggcctgatcgaagccaaccagggcctgagcctcaacggcggcagcctggataacagcgcaagtggccaactgcgcgccctcggtggcgccaccagcagcgtcaacctcagcggtgcgctgaacaaccagaacggcaccctcgaattcggcagccaggccttcagcctcgacgccgtcagcctcaacaaccaggccggccagatccagcacgccggcaccggcctgttccgcctcaacaccgccagcctcacgggaagccagggcagcatcaatggcatgggcaccgccgactgggcgttcggcaaggtcgacggcctgggccgcgtgcagctcaacgaagtcctcacctacaagagcgaccaagggctgaccctcagggccggcgaccgcatggccagcgccaagggcttggtcctcaacgtggccagcctggacaacggcggcgaactgctcagcgacggtgacatcagcatcaccaccggcgacctgaccaacagcggccgcgtctcggccctgcaaaccctcaccgtcggcgccaacaaccttagccagaacggcggccgcctggccgccaccaatgctcgcctgaccctgggcggcaccctggacaacctcggcttcctcaccgcccgccagcaactggacatcgccgccgcgcaaatcaacaaccgtggcaccctcggtgcccagggcgcggtgaacctcacggcggtcaacggcattaccaatgctgccgatacgctgctgttcagcggcggcgacatgaccttgcgcagcaatggcttcagcaacagctatggcgacgtctacagcaaaggcaacttgagcttcgccgcccgcgatggcgggcgcgccgtgctgttcagcaaccgttccggcaccgtggaaagcgaaggctcgatcggcatcaatgcaggctttatcgaaaacgccaaagacgaattcgaactcggccagacgctgaccaccggcagcctgtattgggtctgtggccagcactgcgacgagagcgacaactgggaacgtggcgagatcaccatctacgagacgtaccttgaggcggcaaccaaggattcggtcgcggcgcgcctggtggctggcaaaaacatgctgctgcaaggcgacaacgtgcagaaccgctacagcctgatggccgccaatggcgacctgagcatcaccgccggtgacctgctcaaccagggcgcggccacgcgcacgggccagcgcaagcttgtcatcagcacgccagggcacgttcccgacgatctgttcgaacgcatgcgatatgtcgacgtgcccgcgttcaatgcggccacggcggctggcaatttcgacaaggcgcgcttcgaagaactgaaaagccgctcacccaatagccggcctttcgcctacgcaagtgacgtcaccacctggaccaacaacggcggccccggctacgacgccaccctgcaagcgggcggcacggtcaacctcaacgtcgcccgcaccctgcaaaacggcacgctgcacaacaacaccctggcccagttgaccggcaccctcggcgacgaccagaccggtatccccttcggcggcatcaacatcaacctgagcaaacacgccaacgacccgagcgcccaggcgccaggcagcgtgttacccgtcgtgggcgtggcccccggcggcggcttcgtgcccgtggactacaccggcaccgccttcgccccggtcgaccccaccacctcgcccaccttccaattgcccaagggcgagtacggcctgttcgtcaagagcgccgaccccaccagccactacctgatcgagaccaaccccgagttcgcctccgtatccggcttcctcagctccgactacatgctcggcaagctcggctacacctccgacgacgcctggcgccgcctcggtgacggccagtacgaaacccgcctgatccgcgacgccgtactcgcgcaaaccggccaacgcttcctcgccggcggcctctacagcgacgccgaccaattccgctacctgatggacaacggtcttgccagcaaagacgccctgcgcctgagcctcggcgtggccctcaccgaccagcaagtcggcgccctgacccacgacatcgtgtggatggaaaaccgcgtcatcgacggccagaccgtccttgtgccggtgctgtacctggcccaggccgactcgcgcaacgtgcgcggcaacagcctgatccagggccgcgacctcaacctggtcaccggcggcgacctgatcaacgtcggcaccctgcgcgccagcaacaacctctccgccatcagcagcggcagtatctacactggcggcttggtcgaagctggcaacaacctcaacctgctggcccaagacagcatccgcaacgccatggccggcgaaatccgcggcaagcaagtcagcctcacggcgctcaaaggcgatatcaccaacgacaccaccgccatccaggtgcgtgacggcgtcggtatgcgcaccctcaccgacaccagcgccggcaccatcgtcgcccgcgaaaacctcgccatcgacgccggccgcgacctcaccaatcgaggcgccctgaccgctggcaacgacgccaacttaaccgccggccgcgacctcaacctcatcgccgccagcgacaccagcgtcaaacacgagacccgcgacggcggcgagaaatccagcatcaccaccgacgtcaaaaacctcgccgccagcgtcatggcgggcggcaacctcaacatgcaggccgggcaagacgtcaacatcatcggcagcaccgccaccgccggcaaagacctcaacatcgccgccggccgcgacctcaacgtcgcctcggtcagcgacatgcacaacgtcgagggcaaggaaaaacacggcaaaaaacgcatcaagacctcggacgaccaaactacccaagtggcaagcgtgctcacggcgggtggggattttgtcagccaggcagggcgtgataccacgatcgtggcgagcaggatcagtgcggggaatgaggcttatctgtatagcggggataagttgagtttgttggcagcgcagaacagcacctacagcctttacgacatgaaggagaaggggggctggggcgcgaagaagaccaaacgtgatgaggtgacccacgtcacgaatgtggggactgagatcaagactggtggtgatctgtcactggtcagtggcggtgatcagttgtatcagcgggccaagcttgagggtggtaaggacctggccatcaccagtggcggcgcagtgaccttcgaggcggtcaaggacctgcaccaggagagccacgagaagagcaagggtgacctggcttggaccagcgccaagggcaaggggaataccgacgagacgttgcgtcaaagtgagttgaaggcacagggtgagttggcgatcaaggcggttaacgggctgaagatcgacattaaacagattgatcagaacacggttagccagacgattgatgtgatggtcaaagcagacccacagttggcttggttgaaagaagccgagaagcgtggggatgtggattggcggcaagtgcaggaactgcatgattcgttcaagtacagccattccagcttaggccaaggagccatgctggcgatcatcatcgtagtgacagttttgacggctggggccgcaagtagcgtcgcgggcgctgctgcgggtgccagtgccgggtctggtacggcaatggctgcggcaggcagttcggctatggtctcagctggtacggcggttgggaccgcagcagccggttggggcaacgttatggcaactgctgcgttaacttcagttgccagtggaagcaccgtcagcttcatcaataacggcggaaacatcggtgcaacttttcaagacattacgtcaagcaaagccttgaaggggtatgcaactggggcgttagctgcaggttttaccgctggcgtgcttgatcctgcgtttggtgtaactggcgacaacgtcaatcacattacaaaagggtttgacctcagttccgcgtctgacatcggtaggtttgccgtctattcgggggcgcaaggagttgcccaagcaagtttaagcactgctattcaaggcggtagttttggagacaatctcggtagttccctacggtcgcagttgcagagcacgttgcaagcggtcgcctttaacgctgtaggcgattactcgaaaggccaaaaatggtcagaatcagggcctcaaaaaatcgctctgcatgctttggttggcgggcttttgagtgaagctggcggcggcagttttgctacgggcgctctcgctgctggagctaacgaagcactggtaacctcactggcgaaagtggtagatggcgatccagcgttgttgctagccgcttcgcaattggtcggaattgcggccgctggtgcgactgacggtgacgtgcagaaaggtgctgaaatcgcgaaaaatgccacggcctataactacctaaatcaccatgaggttgatgatttggttaaggatttgaaagggtgccgtggggcagccagcccttcatcctgccgtagcgatgtagctactaagtacgcaggaatcagtgataagaaaactggcattacgctgctgaagtgtgatgatcctacgagttgtaatgcgcagcgcctggacgtggaggcgggtaatgcagcgctggataaatatgaccagagcggcgggctcaacaaagcagaacagtctatcgttcggggcttccaagataagaatcaggacgacacgcgcctcgcggtccagcaaaccatgaagggtgatcattccgaaatggttggcatgatgtttggcggtgggttgggaggtgcgggtaaggttgctgggaaagttattggcgctgaggttggagtagccaaggaaacgacggcaatctcaagcgaggccgctagcgttaacgcccaagctgctttgagaggcaagctttcagggctgcagaaagctcaggaaaatgcggctatcacgaagactttgccggatggccgaattcggtactacacgcaggaagtacccgctcgaacagagggtgctacacgaggtgcttctttcgcaactgagtataaccctgcaactggcgccactaggcagtggatggaaagctatgatcatgcagggaacgtaattcgggtgcatcctaagagcattaatgggcaacctgtgagtgcacagcattatccgcctacaggtgcagaattgaagagttggaaataatgtacacacaaaatgatcttgctaatgatcttgaaaaaaaattatccgcagggttcgacgtgtttaagatttctaaatttgcgtttgaaatttatcaacgtcatggattagagatcactcctccgatggatcgaatacttctctcattgatggcaatggaagaaggggaagagtttgagctgacagaaactgaatttttagatttgatctcagagcttaggattatggattgacagagctcaaaatggagaaaagcggagaaggacgaaaaggggacagatttattttaatttgcgctgggagctattaaataaatctgtcccctttttgttcgttagagtaatagatatccttattgagcaaaatatgaagaataggggtcagaccacgtttttgcgcttttgaggaagaataggaagggaataggggtcagaccacgtttttgcgttttttagagttcagcagagttgctctttaaaaatatg

SEQ ID NO: 7 - DNA, 714271 bp, Pseudomonas fluorescens KENGFT3
gatttattttttgtaattattctatttggttggcctgttgatgggcggctaagctgtaaactcttatccagttaggaggttatatagctcgccgtcctagggttttactgccgggtatcccgttgcatataatacagggggaataggggtcagaccacgtttttgcgttttttagagttcagcagagtcgctctttaaaaatatgatttattttttgtaattattctatttagttggtctgttgatgggcggctaagctgtaaactcttatccagttaggggtttatatggctcgccgtcctagggttttactaccgggtatcccattgcatattatacagcgaggaaacaatcggtctgcgtgtttttattcagatgaagactacattttttacatggatacattagccgtgcttgctcaattgtatggctgtaaaattcacgctttgtgcttgatgacaaatcacgttcatttgttgttgactcccacctgctgcgcaggggctggcctacttatgcaggggctggggcagcgctatgttcaatatgtcaatcgaacatatcaacgaacgggcacattgtgggaaggccgtttccgctcctgtttggttcaacaagaaaactatgttttagcttgccatcgatatatcgaaatgaatccggtcagagcggtatggttgctcatccgggcgactatcgctggaccagctatagggcaaacgcacagggtgagctatcaggctttataagtccgcatgcggtttatagcgagttaggtagcggcaccgcacaacgagccgaagcttaccgatatatgtccaagggtcggctttcatctggattgatagaaaaaattcgatcttctacaaacggtaattacgttttaggcgatcagaagtttgcgtccgagatcgcggagatattaggtaaaggagtttcaccgggtgcgtcaggacgcccgaaaagtgtgagttaaaagaatagaagaatagtggtttgacccctatttttacttctccaagcggattgaagacagaaggttattacggtaaaccagacggtaggggcacgacagcttggccggtctatcaagggaaaaattgataaatatggctatgggtaaaattcattttgtgaaatcttctaaacttaaccgtttagacgtttgggccacagacccaaacgcggacccacggctctcttcaccagaaagtgttggcgttagagaaatagccgcttggctgtctgatgacgtgaacagccgtttgtcagcagttggatggattgagcgattggaagctttagaaagcgcaggagcaaaagcgtatttgggaacaggtaatgctcatcacgtgggggtcattaacgagtacatatttttagagtgtgagtttgtagacgatttcaaagttttgatgcatacgaaaaatgttatttcagtattaaggttttatgtcggtgctcatgaagggtatgcagcaaatgtttgttttgatgtggagtacgaaatggaaggcgagcaagctctgaatcgctatctcgaattgggtgggcggttaggtcttaccgatacggaaatagccgaaaatacgcggaaagttaaattgtcacgtaaaaagaaagcagataagcatcaacagcggtaggtgggatgtatattttttcttcgtcgtcttaaatattttccgtgagtgagttatttaacgattaataatcaaggatggctatgaagaatttgactgcgattctgtgcgccgtatttgcattatgcggttgtgtcacaaaagacctgaatgttgaaaaccgacaaaaaattaagacgctcacaatcttacctgcctcgttctcgaagcagcagttcaaatacacaagcatggatcaagcatggggtgccggcttgggcgcgggtgccggggcagctgtaggaatgggatcggatgcatcaaaagtagcaactagcgctatggcaggagctggattggtagtaggtgcgaaaatagctgctggcggagctttgagtcctcgacaggcagttttgctgaacttgaagcgcaatcaaatagatccggggcagttgtttaagcaggaagaataggggtcagaccacatttttggaagggaataggggtcagaccacatttttgcgttttttagagttcagcagagttgctctttaaaaatatgatttattttttgtaattattctatttggttggccaggaatagtggtctgacccctatttttttacccctatttttcttcgattttgtcacattgccggatgggactatcaaggtcagccgcccaaatgtgaatgagcaattttcaacccatctggggcttagcgggggggggtaagttaaatatgccgggtctatacgctttggtaataatgacggtccagagcgaggaaaaataacaagatgggataatagctccggtcattatcagccacctgctaccctaaaggctaactctgggttaccggaaaactcatttaatccaaggaaatagtttggtatggattcaagattgatatcactctgtaaagagttggcgaaaatgacttctgatcaggcggcagcttggatattgagccggtacccgcttgcttcagataattggggtgaagctttattactccttcctcatagatcttggaaaaaaccagagcagaaacgtttagcggattattattttaagaaaattccgttctctagcgctagaggatatgaagcgttcgcgtcaattatgtcagttaagttaatggttgcatgcattaacgatgctttgcccaaagatcctagcaggctcgagttattgttttatcatcttgtcccagtgcttaagcgttttgcaaagaatgatgcagatcgaaaaattattgaggctttcctttcggctttttcgataagtttgccaaaacataattgagaacaaaaaaatgcggtttgtttgatctggctagagaagtgaaaaaagggagcgggaaaaaagagagcagatttatttgagttaggggaataggggaatagggggcagaccacgtttttgcgttttttagagttcagcagagttgctctttaaaaatatgatttattttttgtaattattctatttggttggcctgttgatgggcagctaagctgtaaactcttatccagttaggaggttatatggctcgccgtcctagggttttactgccgggtatcccgttgcatataatacagcgtggaaacaatcggtctgcgtgtttttattcagatgaagactacattttttacattgatacattagccgtgcttgctcaattgtacggctgtaaaattcacgcattgtgcttgatgacaaatcacgttcatttgttgttgactcccacctgctgcgcaggggctggcctacttatgcaggggctggggcagcgctatgttcaatatgtcaatcgaacatatcaacgaacgggcacattgtgggaaggccgtttccgctcctgtttggttcaacaagaaaactatgttttagcttgctatcgatatatcgaaatgaatccggtaagagcgggtatggttactcatccgggcgactatcgctggaccagctatagggcaaacgcacagggcgagctatcaggctttataagtccgcatgcggtttatagcgagttaggtagcggcaccgcgcagcgagccgaagcttaccgatctatattcaaggatcggctttcatctggattgatagaacaaattcgatcttctaccaacggcaattacgttttgggcgatcagaagtttgcgtccgagatcgcggagatattaggtaaaagagtttcaccgggtgcgtcaggacgcccgaaaagtgtgagttaaaagaatagaagaatagtggtctgacccctatttttctatttttcttgtggataaagcagcgggtaccggattttcccattttgttgtggtcgacggcattacgaccagaaatggcatttctgtcgtagcaattcgtgatcctcatggtaagcagtattttagccccgcgactacttttgaaaagaatttttcaggttatgttgttgttccaaaggatgctctgaaatgaaattaagcattaagtttcccgagaatttgttaacccacagcctgctcgagcaaaggctgattccttgcatttgcaaaattgcaacggagtttgaaattgaatttttggaccctttgccagaaactgcaggaaccgttctggagtgggatcgtgcagaacttgaaaaaagagcgataggtggggtaggtgggcaatactctcactatgcacacggtcgggtgtcgttaaaaaaagttgatattgatatctaccaaatattggatcttgaaatgttttataggctttttggatggtgcagcatcttggaagatggcaactatgcgccgccggggcagttttgggatgatgaataagttgaagaaaaggggactgaagaaaagggacaagaaaagagggcagatttatctaggttagagtttaaaggctgtctagtcctgaaacaggtgtaaacctatttcaggactagacagtccccttttttcgttgattcgtgacaaaaacattggaagggattaagtcagaagcagtaatcgtaggtagtgaagttaataaatggcttgcgaaggactgaaatgagatattacttaatgcgacaagatgtaactgtttgcgataggtgggtgcttggagatgtacatcatgtagataactggtatttcagtgatcctccagttaattttatggagccaggcatatatactctcgatgtaagattcgacggtaaagaagttgattattcccttgctggatacgccagtgttcctgttttaagcgagagcgcaaaaaactcgctcgccggtttgccagagatagacgaaccttatcaacgtgtcgtttttgagccggttaagataaataataaagtggtttgccagagctattttttgatgattatagaaacgcaagtcgattgcgtggatgaaaagcgctctcgctataaaaagtttgaggtagatgatcctgttaggccagatatggccggcaactatcgtgctttctacaatttggtggttgacccgggcagggtcgggtcaagtcatatatttagacttaaaaaatatttgggtgcggtcatagtaagtgaagaggtgaaacggcgacttatggcggctggtgttgtcggcgtactgtttgattctgttaatggtgatcaagaaaccgttacctagttggtcaggtagttgggggaaggcggcgaatttgtttaattcgtggtggtagtgcaaagaccattgattaaatctgtccccttttgttttcttgcagaatgctttcgagctaatgactgatttgaaaaaccaagggcagaaaagaaaatggaatacacacttgaaattcgtgaactcatcaaccatatcacttctgctgaactgtacgagggtgattacggaagccgcctggttgaccatgaatctatactgagtggggttgatgcagcggaccgcgacagtgttcctgtagactatctggcttttctaggcacctttgggtttggcgatttagacagcgcgctttatatcgaagacggtccggctaaatacgctgctatcgccggatgtgaggtggatgcttatagccggatgtatgtgtttgcggctacttccagtggtgtgctttatgcttttgatgtaggtaataattggtcgatagtagagattgattcggaaatcgatgaggtggcggtgttggccgataacttttcaagcttcatccgtaatcagctgattgtggtgaaaggttatgtcgattggcgcgcggagcaataagacgctgtcaggtggggagatgtgattaaaaagggacggatttatttagtttgcgctgatcacgcacaaagcgggcgacacaaaggccgcccgattttcactcaggacggatcggcgttaagcctgcgactgatgacatccagcaaatcacacccatcgcgtagcggaatggccagcaagtgggcgaagtctgaaagcactacggcatcgctgctgagttgttcgcggaaggccaggttttccagcagttgggtgacggcccgaatgcggtgcacggcggcgtcgtgaaggacgtcgagaggtgcctgggtgtcgatgatcagcgctgggacggtgcagtcgtggccggttaggggcatgtatctattcatgggtacaacctcggtcagtaagtgaggctgtcacctgtcgtcgccaaacgaatgggtgacagctgtacgcaggttggcgaaccgggaccgagttccggcagacccgaaggtctcccgcgcacagctgccataaagcagcaatgcgggtacggaagcccctgcaagcaagcagaaagctttcgcatacggtcaacggatcgccaaatccgatcgccctgttgagcgaccgccggactataagcccctcacccaaaaccgcgcaaggcatcaccgcaatggcaccccccgtcacgcaatggcatccatcgtgaagcgtcttccccttgggctttgaacatttcgtatatcccagtgtctttaccccgcccacccgcaatcggtcgggctgcatggactgcagcgttttcaataacattaaggattaatgtgaacctctcccctttacggccccctttctgccaccgctcgcggtgcattggctcgcgcccggaatttgcaggggcgcccggggggcctcattcggatcgattgatcctttcgcacagcacacctactaccgccgggcgtattggcggctttgactgtagttcatggagtttgaaatgaagcgtaagcagttccagaaaagcctgttggcaatcatggtcggcgccatcagcacgcaggtgctggcagtcgagttcgacctggggcagggtaagaatatttgggccagtgagtcgttcaatgagccggtgaccattaccggtcagttttcccgcgtggtcgacaccaacaccaccgaccccgccggcctgggatttgccaatacccaaattcaaggttcgctgatcaatcgcgcagacatcacgctggactcgcaaggccgcaccatccgtgcgatcgccatcgacccgatgttctggaccggcccgagcggtttggccccgagcactgtcaccggggatgtggttcaggcaggcaacgtgctgatgcgcaacggcgcctatgaagggcttgagatcggccccaccaccattggtggcagccttatcaactcaggcaccattcgctccacgcctccggtgggtaccgtgacgacgcccggctacctgggcggcggtgaaggtatttacctgcacggcaccaccattgcgggtgacgtatccaacaccggtgtgatcgacatggccggcccgggcgcgattgggttgatccttgacgtcaacggcgacacgccgaccaccatcggcggcaaaatcctcaactcgggctcgattaccgccacaggcgaaggcgcttggggtgtggaagtggaaaccgacaccagccccctgcgtattgaaaacagtggcctgatttccgccaatggcgatgaggccaaagggctgtttctctacggcggcacctttgattacatcctcaacaccggcaccattgaagccaagggcgcgtctgccaatgccttcgatctttccggcgccagctttgcgcagaacagcgccacgggcgcacgcggcatcgtcaaccgcggcctcatcgcggcggacggtactgcgatccatgtggatacggccgagcaggttgcgagctttgaaatcaaccagcaagccggcgaaatccgcagtaacagcggtatcgccgtcgacgccaacaaccttgccagcctgaactggaccggtggcaaaatcaccggcgatctgctcaacctcagcgccgtcaacatcggcggtcaggcaggtttcagcggtagccgtatcatcgccccggtgtcggtcaactcgggttcgctgaacctctccgcacctggcaccaccatcaccggcgatctcaatgtggccagtggcgcgggcattgatatgcacctggccgacagtgtggtgccgaccacgccgtacctcaccgttaacggcaccgccaacctggcccaggcttccaagctgacagtcagcgccaacccgggcgacttcgcggcgcctaaagccggcacgcaatacaccttgctgcaagccaccagcgtgcagaacaacggtgtggccgtcgccagcgcgtcgtcgttgctgaacgtgctcagctactcggccgatgcgcagacggtcaaggccgtggtggcggtgaaaagcgatcagcaggtgcagcaggagttggcgggtgtgagtgcgggtgcgtcggctgcaaccgcagtcaacgtgttgaaaaacgatgtgctcggccagctcaaccagaacgacccagtgttccagagcctggccaacgccgggactgcacagcaactggcgcagctcgccgaccagctcacgcccgacgtcaaccgtggcgctctcgacgtggccctgtcggggcaaaccgtggtcaacggtgcgatcttcaaccgcctcaccgaccagcgtgaaagccatcaggtcggcggtgtgtgggtgcagggcctgagcagcaacatggaccaggacggccgtggcggcaacaacggttactcggccaatagcagcggtatggcggtaggtgtggacggtcgcttgaacgacaccaccaccctgggcgtggcgtacagctacctgaattccaacattcattcggacctgggcaacaagactgacgtcgaaggccatgcgctgtcgctgtacggcaactgggcgctgcagaactggttcgtggatggcagcctcagctacggccataacgagaacgacagcaagcgccacgtcgcgggcactacggccaagggcagctacgacagtaatgtgttgtcggccagcgtgatcggcggctacagcttcaagccgacccaggcggtggtgatcgagccgcgggtggctgcacgttatgccaacgtgcgcatggatgggtttaccgagaaaggttcgtcggcggccttgagcacggcttcgcagcgttatgaagtgggtgagttgggtgccggtgtgcgtttggcagccaacctgccgctgagcgccggtacgctgcaaccggaagcgaccttgatggcctatcacgatttgatgggtgaccgcgtggcgcaaacctccaacttcgtggctggtggttcggcgttcaccgtcaccggtgcgtcggtggcgcgtgacagctacgaggccagtgtgggtgtgaactaccaggtgtcggacttcaccgtcggcgccagctacacccgccaggcacgtagcggattcgatgcggacggcgtgatgctcaaggcgcgctacgccttctaagcaacaccgcaaaacaaagtgtgggagggggcttgctcccgatagctgtgaatcagtcaatgatgtgttggctgactcaccgccatcgggggcaagccccctcccacattagatttgtgtggatccgcagcgttcggcacggggcaacttgcgctggctcagcccgcttacgtagggcgcgacgctctgataccagtgtgggagggggcttgctccccgatagctgtgaatcagtcaatgatgtgttggctgactcactgccatcgggggcaagccccctcccacattgggtttgtgtgaatccgcagcgttcgggtcggggcaacttgcgctggctcagcccgcatacgttgagcgtgacgctctgataccagtgtgggagggtgcttgctcccgatagcggtggaccagccaatggatatgttgactgactcaccgccatcgggggcaagccccctcccacattgggtttgtgtgaatccgcagcgttcgggtcggggcaacttgcgctggctcagcctgcttacgtagggcgtgacgctctgataccagtgtgggagggggcttgctcccgatagcggtggacctgccaatggatatgttgactgactcgccaccatcgggagcgcgcgccctctcacattgggtttgtgttggatttcactactcgggccgaaacatcttgagaaccgctctcaaccccgtaaaatgccgcagccgttgcatcacagtctttcagggaagaattcaggccagcgtattgtcaggctgcctaactccttggaaaacccggcaacgctgatttcctcacccaaggagcaccctgtgaagacactgtccaaaatcctgctgtcgggcctcaccgccgcggcgctgttgaccgtggccggttgcgccaccgagagcaaccgcgcgatgccggtggagcaagtcgccagcgcccacgtggcctattccggcgtgcgtgtgccgattgccgtgggcaagttcgacaaccgctccagctacatgcgcggcatcttctccgatggtgtcgaccgtctcggcggccaggccaagaccatcctcatcacccatttgcagcagaccaaccgcttcagcgtgctggaccgcgacaacatgggcgagatctcccaggaagccaaaatcaaaggcaccgtgcagaagctcaagggcgctgactacgtggtgaccggcgatgtaaccgaattcggccgcaaagaaaccggcgaccgccagctgttcggcatcctcggccgtggcaagacccaagtggcctacgccaaagtcgcgttgaatatcgtcaacatcaacacctccgaagtggtgtattccacccagggcgccggtgagtacgcgctgtccaaccgtgaagtggtcggcttcggcggcaccgccagctacgactccaccctcaacggcaaggtcctcgacctggccatgcgcgaagcgatcaaccgcctggtggacggcatcaacgccggcgcctggaacccgcgcaactgatcagcagcacctcaaggagcagtacacggatgagcaaggcagttaagttggcgctgatgctgacagcaatcgcgacggtagccgggtgccagacggcgccccagcccctgtatcaatgggagagctaccagccgcaggtttacgagtacttcaagggcgagcccaaggaagcgcaggtggaagcactggagcgcgacttgcagaagatcaacgccagtggccgcaaggccccaccgggttaccacgcgcacctgggcatgctgtacatgaacatgggcaaggatgaccagatggtgcaggaatttcgcactgagaaggccctgttccctgagtccgctgcgtatatggactttctgctgaaaaacgccaaagccggagtggccaccaaatgagcctgttaaaacttaccggcgccttgctggccctggcgttgctcggcggttgcgcggcgcccaagacggttgactactcggcgtacaaacaggcacggcccaagtcgatcctggtactgccgccgatcaacgaatcgccggaagtgcaggcgtcctacagcctggtgtcgcaggtgacgtacccgttggccgaagccggctactacgtgttgccgattgctttggtggacgaaaccttccgccagaacggcctgaccaccgccaatgatatccaggcggtactgccggccaagctgcatgacatcttcggtgccgacgcggcgctgtacatcaccgtcagcgagtacggcaccaagtacatgctgatctccagcgacacctcggtgacggcctcggccaaactggtggacctgcgcaccggcaccaccttgtggaccggtactgcacgggcctccagcgaggagggcaacaacaacggcggcggcctggtaggcatgttgatcacggcggcggtcaagcaggtgatcaacagctccaccgatgcggcgcatccgattgccggtatcaccagtgcacgcttgctgtcggcggggcaacgcaccgggctgctgtacggcccgcgtaacccgaagtacggcacggactgaaccgcgtcacctctgacgacggtgctgttggatcaagtcgatgcgggtggccgtgcccatggagtcgcgctgcccgttcacgctggcgccgatggagccgttgtgcaaggccacgatctcgcccgtatcgacgctgatcagcggtgagccagaggtgccgggtttcttgaaggcgtcgtggtagaccgtgccctgattgcggctgtcctggtcgtatcccttgagcgtggtgggttggcccttggcatttagaaatgaaatgccgagggcctcttgcccatggttgggcataaagattttctgcccaggcgatgcttgggggccggaggctaacttgagcggccggaaatgctcggccaaggcttttttctcgccagcgggcaagtcgacacgcagttcggcgtagtccaaccgtgcgtcgccactgagcgggttggggtccagcggcactttgcgctctactttcatccggccggtgctgtcttgttcggagcccagccaaagctcgagcttgctgcctttggccagcgcgtcgcgcacatgttggttggtcagcacgctgttgccatcgttgatcagcgagccggtacccaacgaacgggtatgcacgcgctcgtagccccatgagtcccgtgtgacgctcacttcgcgaatattgcccacggccctggccgctgaatgcatcggtgtgcccttaagggatgcattggcgtagttctgcaaggagaacggcgcctgttgcggcgcggctgttggcgtgggatggggcttgtacggtgcgacatccgctggcgacggcggtcgcggggttggcggttgaggcgtaacccgggcgggtggggtcggcatagggttcggctgggaggctcggctgatcacgtcgtctggcttgattggcccttggctcttgataaacaggccggcttggcccgagccgttcaggtcaatggccaggctgtgctggcgcgtgttcgggtcataaccgagcaacgcctcgcccggccgaccgctgaaacgacgtacaaactgcaggtccttgatcccggcggtatgcagcgcagcggacacatcgatcttgtcctgcccactggtgaaatcagtgatcaggtcggggcgctgttgggtcgactcgctggcgctgttatacacaaaggtatccttgcccagcccaccggtaagggtgtcctggcccaggccaccggtcaggcggttatcggcctggttgccgataagtcgatcagcgcccgtgccgccaatggcattttccagagtcacgcctttggcaatggagacgttgcctttcatgccgccgacatcggagaagtgttcagccttcaggttgatggtctggtcctgatgaaaccgcgagaaatccagggtgtcgttgccgcccccatcccacacgctgaacacgggtgcgtcgtccgctgagttgaggctgaggaagtcacgcccggtattggagttgaagccgtacaccgtgtcggtgtcgcgggttttgtaattagcgccgtagagcttttggatggcggtgatgtcgtccatcagcggcgcgctggcatagtgggtttggccgttcttgttgtggtcatggcccaggtgaccagcccaccagtaactcatcaggctgtaggcgcgattgtcctcggcatagccggcgctttcagcgtagctgccgccattgttgtatttgccggggtgcatcagccccagggtatggccgatctcatgggccagcagataacggctgaaactgccctgggtgaaggggcgattcatgccatcggacgcgaaccaggcctgtgtgccatcgctgtagatgcctggataagacgcacggcccgaatggccggtctggttcgggtcattgcccagtaacagttgccctttggcctcgggtgcattctcagtgaaggtgatattggcgacatccgcccaagactgcatggcgcgcctggcctgctctttttgcgacggggagaattcgttagcgccggcgggtgtgctgtacgtggcctgcgaaggtgtgaaaaaacgatagccgatgggtgtggtgccatcttggttacgctctgtccaacgatagcctgttcgggtgatctgctctgccgcttgctcggtggtgtaggacggcttgcctgaagcggccccggcatagctgggccgttcggcgaatgagggcggctgatagcggtttgcgagggtgtttacggagttcatcgcggtttctctgatttaaagcctccaaagcactcaagaaacagacggttctgacagggaggctgaccctcgatatgtggtgggtggtgatggcaggttcagttggttatgtctcgaaaggtgacgcagcgagccgacggcgcaatatccgcgtttaacccgtagggaggttgggctacgtctgatcggttgaacggatcattcattcacgaggttcagcccatgtcccgctctctgcttttgctgcgtcctgctgcccaaggctttgccgttaccgtgctggtgatgctggccgggtgtgggctgtcgtcgtccccggatgtcgccaagcctgttgaaccggcgcccgtcgccgagctgcaaagcgcgccgatccagggcgctatggtcaaacgcatggtgatgccggcgccgatgagagtgcgggaaatggcgacgatggactaccgcagcgaacctcgcgagcaatacgccaacctgccggacaacccggtgcatcgcgtcgccgaaaccccggtttccactttcagcatcgacgtcgacactggcagctacgccaacgtcaggcgtttcctcaatcaaggtcgcctgccgcccgaaggcgccgtgcgattggaggaaatggtcaattacttcccgtacaactacgcgctgcccaccgatggatcaccctttggcgtcaccaccgagctcgccgctacgccctggaacccgcgcacccaactgttgcgcatcggcatcaaggcctccgaccgcgccgtggcggacctggcgccggctgacctggtgttcctggtggacgtgtccggctccatggaccgtcgcgaaggattgccgttggtgaaaagcacgttgaaattgctggtggaccaactgcgcgatcaggaccgcgtgtcattggtggtctatgccggtgaatcccgcgtggtgctcaagcccacctccgggcgtgataaaaacacgatccgcaacgccatcgaccaacttaccgccggtggctccaccgcaggcgcctccggcatcgagctggcctaccagatggcccgcgagggttttatcgacaagggtatcaaccgcatcctgctggccaccgacggcgacttcaacgtgggcatcagcgactttgacagcctcaagcaaatggcggtcgagcagcgtaaaagcggcgtgtccctgaccaccctgggctttggtgtggataactacaacgaacacctgatggaacaactggccgatgcgggcgatggcaattacgcctatatcgacaacctgcgtgaagcgcgcaaggtgctggtggagcaactcagctcgaccctggccgtggtcgcccgggatgtgaagctgcaggtggaattcaaccccgcccaggtcagcgaataccgcctgctgggctatgaaaaccgtgccttgaagcgtgaagatttcaacaacgacaaggtcgatgccggtgaaatcggcgcagggcatacgctgaccgcgctgtacgaaatcgtccccaagggcgagaagggctggttggagcctttgcgctatgctgccgcgcctgcggttgaaggtaaatccgacgagctggcgatgctacgggtgcgctacaaacctgcagcaggtggcaacagccaattgatcgaacgccccattgccaaccagcccaccccagccagcgaagacctgcgtttctcagccgccgttgccgcgttcgcccaacagctcaagggcgatggccgctacactggcaacatgagtttgcaggacaccgccaaacttgcccgctcggcccgcggcgatgacccgttcggcctgcgcaatgagttcgtgcaactggtcgaactggccctgagcctcaaacactgatatcggccatgacaacaatcaaatgtgggagggggcttgctcccgatggcggagtgtcagacagcacatttgatactgatccaccgctatcgggagcaagtcgaaccgtcgcaccgcccctcccacagttagttccgcttcgactgatagaaggagttcaccttttacatggccgttccagacgactcacccagcgacgaatcgctgctggcccgctaccgaaccggtgatgctggcgcattcgaagccctgtacacgcgccaccgccagggcctgtaccgctttctcatgtccctgtgcaacaaggccgaactggccgaagaaatctaccaggacacctggctcagcctgatccgcagcaacacccagccacagggccgggcgagttttcgtacgtggttgttccagatcgcccgcaaccgcctgatcgaccactggcgcaaacacggcatccacaaccccttgcacgacagctacgatgagcaactgcacgcccaacccgacagcagcgccggcccagagcaacaactgagcctgagccgcgaccaggcgcgcctcgacgctgccctgcaagacctgcccgaagaccagcgcgaagtcttcctgctgcgcctgcacggcgagctcgaagtaccgcagatcgccaccctcaccggcgccccgctggaaaccgtaaaaagccgcctgcgctacgcccagcagaaactgcgccgcctgctggccgaggagatacccgcatgaacgactcccgacacgacccagacaccgacgacgggctgatccagcactttcgtcaacacagcagcggcgagccgccggcgtcactggacgcgttcatattggccaccgcccaccgcgagacaccaaaaccatcgcccaacctttggcagcgctggctgcgcgtgtgccagcaaccgcgttggcaaatggcattcgccagcgttgccggtgtggcgttgctggtgggtgtggtcacgcgcaccagcgagtttgagcacgtgccgaacacgcgcctggctgccccggctgcgttctctgcgcctgcacctgcgcctatgagcgcgccgccacgcgtcgaatcgttcagcgccgaaatgagcagcgatgccttgccccaagccaacatggccaagcgcgctgtgccggaaccgcttgagcagggtttgcaggacgtgttacgcctgcgccaggcaggtgatgatgcggcggcgacggcaaaactcgccgagctgcaaaaacgctttcctgcacagaacctcgaggaacgactcaaggcattgcagcctcactgaccccatggcgatggtacccagcggtaccatcgccgaacgtctgaaatgcgtcataagcatatgaatttatattcagttgctcagggagtaattgctgctagtttaataggcgaaagacgtcattgttcctgctggccaacagagcgggtcatgtttcattggatgaaaagttgcatgcggacttcaaggattaaagtcttctcagcattcgctacatggccactgggaaatagctctacctgttggaagtccattcaattggattgatgaacggtacctgtatatgacggcgacgctgaattactcattggcacaggcagtgcctgaactacaacaacccctggatatattcgagcttaaagagtccaacgtacgctcttattgccgagactttaccgacacgttccataccgctgagggttcaacgctgaccagtgagcaaggtcagctgtttatcgactttttcagtggtgccggtgccttgaactacgggcataacaacccggttctaaaggccgcgctgctcgactacattgcgcaaaatggcatcacccacggcctggatttcaagacgaccgccaagaaagcgttcctcaccgcatttgaagaacaggtcctggcgccgcgcaacctgcgttacaaagtgcagttccccggccccaccggcaccaatgcggtagaggcggcgatcaagctggcgcgcaagtacaccgggcgccagaacatcgtagcgtttaccaatgccttccatggcatgtccctgggcagcctggccctgaccagcaacccgcgcaagcgagccggcgccggcgtgaccctgagcaatgtcacgttcatgccctatgacggctacttcggcgacagtgtggacacttcgctgtacctggacaggatgttgcgcagcggtagtggcatcgacaaaccggcggccatcgtgctggaaaccgtgcagggcgagggcggtgtgaacagtgcctcggccgcctgggtacacactgtgcaacgcatcgcccaggcccatgacatcctgctgatcatcgatgatatccaggccggctgcgggcgtacgggtgactttttcagtttcgaagccctgggcgttaccccagacatcgtgacgttgtccaagtcgatcagcggttacgggttgcccatgtcgctggtcttgctggcgccccatctggatgtgtgggagccgggcgagcacaacggcacgtttcgcggcaacaacctggcgttcgttaccggcaaggcagtgatcgaccactattggagcgacgcgggtttcactcaggcgctcaaggccaaggcgggcgtgctgcatgatgcgttgcagaggctgtccgcaggtttcgccgccaaggcgcccaaccgcctgaaagggcgcgggttcttcaagggcatcgagttcgaggacgcgagcctggcgcagaaagttgctgcgcgcgcctatgcacatggcctgatcattgaaacctccggcatcgataaccaggtcctgaagtttcttccggccctgaccatcactgctgcgcagatcaaccaaggcgtgcagattctcgagcaagcgtttgccgaggtaatcactccatgaccgatgccattatcacccggcacgcgtccctcgatgacgccgctgccatcgcacccttgctggataaataccgcgagttctatggtgaaacttccgacctggctcgctccctggcatttattcaacaacgcttctttttaggcgagtcaattattatcgtcgcgcaagtaaacaatgaagtcattgggttcacgcaactctttccgagcttttcaagcgtcacactagagcgcctgtggatactcaatgacttatatgttgaagcctcaaaacgaagggcgggagttggcctggcgttattgaatgccgccaaggcattcgcacaaacaaccggcgccaagcagttattcatcgagggcgcagacgacaacccaaaggcacgaaacttatacacccgctttgggtttatcgaaaacacggcgtatcactattaccatcttccattgaagccaatccagggataggagcttttccatgtcagacactgttttcgatatcgtgggtattggttttggcccctccaacctggcgttggctattggccttgaagaatccgcttctgcgctgacctatcgcttcctggacgccaagcaaacgccggactggcaggatgaaatgttgctcagcggttcggatatccagaacaaccctttgcgcgacctggtcaccccgcgaaacccgcgcagccactatggcttcgtcaactacctgaaagaaaccggtcgcctgttcgactacctcaacctgccgctgacgtatccgctgcggcgtgaatatgccgagtacatcaaatgggtcgccgggcattttctgggcagtgtcgagtcctctgcgttcgcgcaaagggtcgagccgttgctattcaaaggcgagcaggtgtggaaggtcacctataacgatcagcgcgtcatttacgggcgtagcctggtgctgggcaccgggcgtacggcgaatatcccggcggttttcgagggcctgactggccctcaggtgttccacctcaatcactacctggagcgcctcaacaagctgcctcccagcgtgcagcgcatcggtgtagtgggctccagccagagtgccgtggagattgtgctcgacctgaccgccaggttcccggacaaagacatctactcgctgcaccgcagcttcagcttccggctcaaggacaccagcccattcagcgacaaggtgtatttcccggagtttatcgactactacttcaacctgccgcccgaggccaaggcgcgggtggacaagcaactgcgcggcaccaattacagctcggccgatgaagatgtgatcaacgccctctacgtacgcattcatgaggaaaagttgcagggcaagcagcgcattcacattctcaacaacatcgccattgagcaggcgcagatcagtgcatcggggcaggtggagctggggctcaaggaggtcaaccaactgacccactcgaccctggcgctggacgcactggtgctcgccaccggcttcaaggacattgccgccaaggaaaatggcgagctctatccgccgctgctggcgccttatcacgcacggtttcatgcggacgcccacggcgcactagtggtcaaccgcgattacagcctcacgtctcttgaggacttgcccgccgtgtttctcaacgggttatgcgaaagctcccacggcctgggagacgccggctcattcagcctgatttcgctgcgggtcgaacacatcctggcgtccctggaggaaaaactcgcaaaggccgaagccccgctgcacgcattggcctgacctgccctcggcagcagcctgcgccggctgctgcctcatacaaggagttcccatgtttacagcagcattgatctatatcctggcggtgataagcccggggcccaacttcatcattgtcagccgattttcttcgctggggtcggtctcgaccggtatcggtgcgaccctgggcatctgcacggtcggcgtatttttctcaaccctctcattgctgggcctggcggcgttgctgcatcaatacccggcgttttccaaagtcgccaccttatgcggctcggcgtacctgctgtatatcgcctacagcatcatcaaaagcgtactggcaaaaaacaccggcaccgccgacaccaccgccccgggcgcgaccagcttcgccaaggcttaccgcgtgggcgtcatcaccaacatcagcaacatgaaaaccatcgccttcatgatcagtatctacgccggctttctttcatcgccgcgtacggacatcgaaaaagtcctggtggtgctgctgtgctcgacgctcgaagtcatctggtactccgtggtggccctgctcttcggtcagggcccgatcaaagcgctgttcctcaaatacacccggcagatcgatgtgggcctggccgtattcctcgtggcgttttcactgaacaacgccattcctgtgctgatagccagtcgatgaggcttcgccatggaatggaacgcgttgctcaaggatgtgggagggcgcttcaagcatcgtagttggttgttgattgacctggcgccggaggcgttggtgctgagcgatttgtcgggggaattggtgagggattatctgggggtgacgttgattctggattgtcatcttgagggggtttttcgggtgattgatgggtttgggccgggggttagctatgcggcgtcgttgcaggctgctcgggggaagggtcactacgtgactgctgtgttgcctggggaggtggctttccaggactttaaatgggcgtgttgagcgcacacaaaaaagccccaggtcttttggcctggggctttttcatgcgtaggggcgcttgcattgcctagctgggtatatgtcaaagtctgccaggcgcgcgatttacccatctgtgtgaaatagaacatttttgggctgaaaaaaaacacaggggcaaatacgcatatactgtgcacgatgatggtaatagttgtctgatgttgtggcatgaggtctgttgagcgtcgatgaataaaactgatctactgaactatttgaaagagaccagttacgcgatgacccaaagtgatatggacgaagctattcttctccacttcgaactggtaacgcaaagctatagaaaaaagccgtttttctacaagacgttgttgaaatacgacaggtacatggtcgcgctctccttattaagcttcagttatgaagatggtcgcgttcccttgtctaaagtcaaggccttctgtcaggagcgaggctatctttcgcgcaatagcctggatgcctatttttcttttttttcatctccgggtatatgcatgttcacctgcacaacgaagatggaaggcagcgtattttcggaccgacacaaacggcattgtgtgaaaccgcgagtatgctcaaggcgtatctgttgccgtcgcaaatgatcgtgccttatttgggccgccaggtgaacgccttaaattccgaagatttattgcgctatttcttcagaggcttttccaagttgcttgaagctgacttgatgcttgacaaactaatgcccgaaacaatgtggctcgtcaatcgagccggggggcatctacccatgctcgcgctttatacagatgcaatgaggaacggttcgttacactctaatcagaaagtctcatcctatgttgagctttcgaaatgtttgagtgtttcaaagacgcatttgatacgtatggttaaagaaggcgaggtgaaaggttattttaagtgtcacaaacattcggtagagctgcgcccggtgtttctggaactggcgcgtaagatcatgtcagtgcatttttctgtcgtgtgcataagcattgaattgggcatggatatgaaagccgacaaatacgcatgctaaggctttcggcgttcggtgaaccgtcaggcctttagacgtttccagatgacgggtgactgtgtcggtgtagttgatgggcggcctcaaagattgacgagcatattcgatggtcttgggaaaggagtttatcaatgccggcgattttcaagattagaccgagaatgcgaacgctgttatcaccagcagtcataaaaattgagttggtaggtatattgtcgtggctgggggcgcttttcattgattcggtatctgcactgaatgtgatacacctgttgatcacgctttgcttgttgagcgtttggtacgttcatcgcgtgatacgcagttttttaatgtggagggtgatgggcggtctttacatttttgtcctttcagtcgggtttgcctacattattcgctcgcatatggagctgcgaatatttgccttgccgttggcagtgatcattgtactcagcagcgctatcttatttataaccgttagtgattatttgctgtccagcgtgcaggtctggctactgatgtggacccatattgatatcgatatataccgcggtcaagagttgtacttactgttgttttgcctctcgtctgtgtcgattggctttaccctgagttttacctatttgagaaatttgcgctcggtgttattggtagagagtgagatcaggacgctcgccgagactgactttctcacgtctttgctgaatcgtcgcgcctttatggaactcttccaaaagctattggcggatgggcggtacggctatttcatcatgttagatatcgacggctttaaactgaagaatgatcagtacggtcatgatgtcggtgacaagatcctgtgcgccatggccaactgcctgaaatcaacaccgggcagttactgtgtcggacgaatcggcggtgaagagttcggggtcttggtgttgggcggcgacgacttggtggttcaggaatacgcgttgcgtttattgggtgctatccgggccagtgtggcgcccccgcatcattacacctgcagtgcgggaatagcgcgattctcggaaaactccgacatgtcggcggtgctcaagtgcgccgataaaaatatgtatagggccaaacataacggcaaggatcgcgtgtttcaggatggcgaacaggttggcgcactcatgcttcctctttttgcgcaataaccatcaaacgtgggtgtgatcatgaatatcgagattgactatattgactcgccgccttgctacgtcttgacgatgggtgaactgactttgatgtttgaaacgcgtgacgaggcagaagagtttattcggttcctgcgcggctccgacgatgaagaaaaaaacgtcaaggattagatagcttcatctgggcgcggaaatggtttagcaactgttttttgtcgggagtgatcagcgctttatcactgaagcctcctcgccaataggtcggtgcatcttttaaataacctgagcacatgcaatgaagtggataaaaaatgcgaagcttgcaaccaagctgttgatgtccttcgttttggttgcgctgattacgttggtggtcgggggcatcggctggagtggcgtcaagaagttgggttttgcactcaatcttaccttttcagacaccttggtttcggcttccagcgtgtccgaggcgaaaggcttgatcatgacgcacaaccgcaatctttatcgtttgttgacgtttgcggcatcgggcgccgacagagcggatgtggaagcggtagcgcgagcattgaatgacacccagcaacaggtcgataaggtcttccaccactatcgctcaaccccaatgggcactgaagagcgcctggcaggtgaggcattcgagaaactctgggcagcttatctggtaagcgccaaacaggtcattgaggccattaatcaagcaaacttttcatcggccagaaacctgttgagcaatgaaaatgtacgcgccatgagtaacgcccgcgagcagctggacgttatcttgggcatcaacagggttgaagtagacaagcaagcgcaagccgttaacgccacgatcagtgagtcgacgactcagttgctcgtgggcgtattgctgtccttcatgatcgccattgcgttgggggtgtgcattacacgcagtatcacccgtccgatcgcctcggcggtcatcagtgccgagcgggttgctcgtggcgatctgactgaaatgatccgcacccatcgtgaagatgaagtggggcagttgcttaacgcgctgagcgcaatgcaacggagcctgaaaaagacgctacaggaaatcgcgagtgcctcggatcaattggctgccgctgcagaagagctgagcgccgtgaccgatgaaagtacccaaggcttgattcgccagaacgacgaaattcagcaagcggcgacggcggtcaaccaaatgaccgtggctgtggaagaagtggcgcgcaatgctatttccacatcgcaggcttctgaagaaacgcgcaacgaggcagtaaaggggcacgctcacgtcgatgatgcggtgatcgggatcacgcgaatggtcagcgagattgaaggttcggccggtaaagtcgaatccctcgcggggcaagttcgcgacatcggcaaggtgattgacgttatacgcagcgtcgcagagcagacaaatttattggcattgaacgctgcgatcgaagcggccagggctggagagcagggcaggggctttgccgtggttgctgatgaagtacgcgctttggcccatcgcacccagtcatcgaccgttgaaatcgaagggatgatcaatgccgtacagcaatgcgcggatgaggccgttgccgcaatgggcgatagtcggtccttggctacgcagacgcagcgcttggccgcacaggccggggaagtgctgcaaagaatttcgctcggcgtcgcgcaaatcaatgaccgcaatatcgtgatagccagcgcctctgaagaacaggcccaggtagcgcgtgaggttgatcgtaacttgacgaacatccaggacttgtccgcgcaaacagctgctggcgcgaatcagaccaatgcctccagccatgatctttcgcgactggcgctgtcgttcaatgatctggtgtccaagttcaagctctgaatgaaggcctgccccgtgccggcaggggtgggttttcaaggttttataactcgccgtgggccttgtaccaggccaccgtgtcagtgagggtctggtccagcacgcgaaagctcagacccagttcctcttcacttttgcggtggtcaaagcaggtacggtgctcctctcgtatcaacagccgcaacgtcgccatgctcagcaaaatgggcttgccggtcaggtaggcgtaggcctcttgtactgcggccaacaggtaaagcgcaggcagcggcagttgccgggacggtgtcttgaccccggcgatacgccccagcactggaatcagctggcgcatggtcaagttgcggccggccgcgagataacgttcgccccgtcgcccactttgtgcggcggcaatgtgcgcccaggccacatcgcgggcatcgaccagggaaaaggtgccgggaatcagccccggcagcttgccgttggcgacgtccttgaccagttgcccggaagaggtcggcccacggtcgcccggcccccacatccaaccgggtaacaccatgcaggcgtgcatctgcggatggctgtcgagaaatctcagcacctcccgttcagccaggatcttgctgcgatagtagtcatccgcatcggcttcggcgcgcaggcacgtttcgtcgatgggcgtgccgggggcaccgtcgagcacggcaatcgatgacgtatgcacaaaccgtcgtacaccggcttcataggcatgctcaagcagtgctcgcgtaccgacgacattgatcttttccagcgcttcccaatggctaccgcccttgtagttatcgcgaaagaacgccgcgcagtgaaacaccgtatcgcagccttgcagggcggccgcgaaggcgcccacatcggccatgtcccccaccacctgctccacgcttggcaaatcgctgaactgctgttcgcctttggccggcgaacggaccaaagctttgaccgcgtagccacgtgcgaccagctcccgtaccaggttgttgcccagcaagccggtggcacccgtcacaaaggtacggcgcaagcggttggggttcgttttcatacaggccattccattcgtttaaaggcccgtagatataccggtcagaccgcgcctgaaaaacggcgactgctgcataatggctttgcacatcagcagaccagggaagctcatagatatggcgttgcaggcaaattgggacgatcttcgcctgctgttggcggtttcgcggcgtggcagctttttgcaggcggggcagatgctcggtgtggccgcgtctaccgtcgcccgccgccttacccaactggaaaccgccctgggcgagccgctggtggaacgaggggttgaaggctgccggctgacctcacggggtcaatccctggtggacgtcgcactcgcgcccgagtccggcctgcggcgtcagaccgcggtcgacggcgcgcaggcaacgctaagcggcacggtgctggtcagcgccggcgaagggttttcagcgagcgtactggaagccgccagtcgctttacagcactgcacccaggctgctccgtggaattgcagaccaccaccgactttcacaagatcgtacgaggcctcgccgatatcgccgtacgcacagcccacctgggtgaaccatccctgatctatcgagggctcggcaagctcgcctatggcgtcttcgcaaccgccgaatacctggaacggttcccggcgctaacccccgccaccgcagccaacatcgccttgctgccacccctgaaccttctaccgcaaatgcgcgccgcaaaagccgccgggctcgatcatgcgccgatcagcgtgagctcgtttgccgtgcagcttgagtcggtgaagcgagggatgggcgtggcggtgctgccgcgggttctggcgacggggttgagcgaggttttcccggaaatagcactgccgccgatggaggtttatctggtgacgcggccgcaggcgttgaagcaggtgcatattcaggggttttttggggtgttggagggggtgttgcgtgaggctttgagtggggatggggaggagttggtggcgtaggtggtgtgatgaattgcagtacagggcatcatcggcaaaaagccataagtcgctgggtagggggcatttttaatacaaaatcggcagcattggcgtgccgttgcaagttatttttgatcaaaaagtgatctattattagctatttagatatatttagctgttcagctaaatatgggatttgagctaacctattgctcgtatctgaagttttgctgcccagctaaagaggactagagctaaggtatggaaaaacatcatgactggggctccaagtttgaacgcgaagtcttggatggcttagtgcgtagtcttactgagaccttcgggcctgaagcgcgccttaagatgcactcaggtctcgatttttatcatgggcatgaaggtctgactgcgggtcccgacggcgtaatagagctgagtacctctgccacagcgctaaagatcctcgtcgaggtcgttggcagtgcctatccccgtgacatccgagacgcggtgtggcgcttggacagttttgaacgaagtcgcccccacgaggtgggcagtgttcggatgattgcagcgcaatctttgagccctggcgcaaagaaagaattgaaagagagagacatcgcattttttgagctaggcggaagcctttacctcaaacatgactactggctaatcgatatacagaggccatcaaagccccaagcctcgaagcgagcgccacagctttttaccggcgctcgcgaaaacgttattcattcgcttctaatgcattgccatgagtggatgacgggggccgagttatcagatttagcaaaaacctctcagtacacatgctcaatggtgcttcaagagctaacgcagcgcgagtggtgcgagtctataggaggggggccgacgcatcgcagacggttggtcaacccaggagctttgctcgacgcgtgggctgagcagtggcagacacgaacacgtgagcgctcatctacttggtatacgtttgtggaaaacccaaggcacctgcttgcacggattgccgaaacaattatcgaaaaacaggtcgactttccctgggcgtttacaggtgcggctgcaggcaacgtattcgtaccattgctaacaaacacagacactgtcgacctgattgtccctaagggatacacagatgacatggcggatatgctcaggctcaagcccgtaaaaaaaggcgcgaacgtaaccatcaacgagcgtgaaggcgctagcctgctttttacacaaccgcatcctgaatatcctgcatattttgcgagcccatacattcagtatctcgatctcctcgacgggcgggggagaaacaaggagctggctgagcacatcagaaatcttttggaggctgaatgggcaaggaattgaaaccccgcacggctgcggggtacgacgcagatgtgacgagcgcctgtgagaggaccttgcttacgctactcagtgcgttcggcaatttgaaggacacattacgtttagtcggcggtctggtgcctcgatacctgactcccgaagcgccaccagaggtgccatcgcatgcgggtacgtctgatgtagacattgtgctcaacctggaaattctcgcgaccggcgatgagtacgtcagcctcgccgatcagttgaaggcacgcggcttcctacgttgggtcgaggatggcaagccaacttcctggagatggcgcaggcaggttgatgaacatattgaggtcgtcgtcgagttgttgcgtgatgccggagacgagcagcctggaaaggcggtaagcgtcagcggtgagcacgtttcggcactgaccattaaacacgccagaatcgtgcacgattggtatcaagaaagagaggtgggcgctcagttgcttgatggtgggggagtgtcggtcgatatcgtacgttttgcagacgtacctgcattcgtaattctgaaagctattgctcttgaccagcggcaagagaacaaggatgcggcggatctcatccatgtagttcggtacacaggctcacttgaaaatgttgctgggctttttgtggagcggattcgtacggggaagcatcaagaggccgtgagagatggattggctgcactatcccggcgcttcggcgatgatgaattcagcgatggttttgaaaaggtgggagcagtcgcttatgcaaggttccatggcggcgaagaagacgaactgatcagcgcacagcgttatgcagcaggcttgattcaaggcttgctcgctaaaatcgaagctcagatggcgaaagtgacttgacccagtttgttcaattactttgaaactgtacgttactcataatgccgacctctacaatctcaacgcgacttaatgcatctatccggtagataaaactcaaaaagaaaaaagccccagatctcgcgacctggggctttttcatttcatatctggtgcacccggcgggattcgaacccacgacccctgccttcggagggcagtactctatccagctgagctacggatgcttgtgcgggcgacatcatacccatgtcgacctgatgcgtccattgcagcgttccccccgctccctgtcgtccattcccgaaaaaatggctaatcgccaccctcattcacaactccccgcgccgcgcgtccctttgtttgctttgctcttgtggctttaaaccgcttccacgccgcaattccccaggtgaacgcatgcattccaaaggaaccgtgatgctcgatctcccgctgagacaaaccctgctggctcgctccgatttgtttcgaggtatgccggagcacctcttgcgctacgtggccacccatatggtggagcgcacgctggatgatcgtgagctgttgtatttcaaggacgacaccctcgaattcattgcgctggtagtggagggccggatttattcggtggtgcatgggcccgatggtcgagagcagatcatcggcagcaccggggccgggcaggtggtgggggagacggcgttgatcaaggatcatgggcgtgagtcttccacctttgccagtggccctacgcgtttgttgcagttgggcagtcggcatttcggcgtgctgtttgaggagccggcgtttctgcggcgtttgttgatgctgatgatgctgcgtttgctgcaggccatcgagttgctggagttggtgtgcctgcatcggctggagtcgcgcttggcgcggtttctgttggccaatttgggcgagatcgacctggcgctggccttgcccagtgtgtcgctgcccgccagccagggggtgttggcgtcgatgctcaacaccagtcgccccaaactcaatgtgcagctgcaattgtggcgtcgcagtgggctgatcagcggcaagctggagcgcatggtgatcaacgatcttgagcatttgcggcgcaaggcgtttgccttgaattagtcgtgaccctgttccccaggtaacagcgcgcccctgtcccgccctcgcagactggcccttcatcaaggatgcacaggagtgcgggcgatggggatgactgttcagttcaaggatcaatgggccgccgatgaccgtttgttcgaagcgagttggcgcgccgtgcagggtgaactcaagcggcgtgcgttgcggcgggccaagggcaatctggatcagggccaggagtggttgtcggccacggcgatcaaggccctgttgttttttcggcgctcgcccgagcgcattcgtgaccctgaggggtttctgtttctggtgctcgaccatgtgtttctcgacagcgtgcggcgcagcaagcgcgaggggcggctgttcgatgattcggtggaccttgagcacgatcacctggccgcgctcgccgcgccctgcgcgtcggtgctggagcgggtggagtgctacgagcgcctggagcgggtgaaggcgcaggtggcgcggttgccgatgatgcagcagcgcttgttcgagatgcgttttgtcgatgacctgccgtatccgcagattgccgccgagttgcaggtcaagttgccgctggtgcgcaagcgcgtgcaactgctgcgcagtgccttgcgctgagctggattcacagaagccggcgcggggcgttctagttgtatgagcgcgtcctgccgccactatccacgcccaaccctgggcgaatgccatcaaggagagatgtatgacagaggtcaacagccagatcaccgacgcggtcacccaaaccaacgtcaaggtggtggcagaggcgccggcccaggccatcgcgtcgctgtatcaggtcgccagcagtgcggcgggcctgtcgttgcagaacgcggtcaacagccagcaggcgatgaaccagatttccaatgcggtgatctccaaggccgtggcgctgatcatgcagattggcgagaagggctgaggcctcgggagattgattatgtcgtggttcagtcgcaagaaacccgccgcctcccaagcaacgcccgccgccgactcaccggcgccagcgcccactgcaccggcttcgcgctcgatcatggcgcgcatgaacgagcacctgctcaaccaggtaagcacgccgtcgcccgacagcacggcggcgctcaatagccagatcgtgcaggcggtgcagttcaccaacgcgcagaactttgcctatgcgccggcgcagatcgcggtgccggccgacatgatgatcagccaggcggccgggctggtggcgcaggcggcggcggggtacttcgacggggtcagcaagatcgccctggcggcccaggccgtgctgctccagcaaatgaccgagaacatcgtcaacaacaacctgccgggcgccgccgaggatgcactgggcgcgttagccaccgacctgctggtgggcgccgctgccgctgtggccgccgccgccggggcgatggaagccgaagccgccagcgtggccatcgacaagatcgaccagagcatcgccaagtacgcgagcaccctggccaatcgggccgcgccagcgacctgaaccgagcacagcgttccagcgttctgctggagcggtgcaacagcaacttgaaagcaacttttcttgagtgaggagcgacatcatgcagcctggagatattattttttctgtcaaacaagatgacgacagcgctacgcgggcgtttatcaaagccggtcaactggtcaaggccaaggtgttctcgcaggacacgacgtacctgaacgtggtgcatccggcgattgcggtgagcgacaccctggtgatcgaaagcgtgggcagtggcctggccctgaccgacctgagcctggaaaaaccgccgcgctcggcgatggtgttttcctgcgtggataccgaactgggcgaggcggcgacggtagctgccaagcagttctacttcgacaaaatcggcggtgatattcggggccgctacagcgtgtggaacgcgatgatttcagctttccggcgctggacttccgataccagcctggtgacgcggatcaacgagtccatcgacatcggcagcgggtccttttgttcgcagttcgcagccaactgctatgaagtcggcaacctctacaacgaagccaatctgctgccgcctccgcctgccattttccccaaccagcctagcgccataacgcctgcggagttggcgaccttctgtgattcctcgccgcacttttactttgcaggattctggcaggacaacgttgaggtgcggctttagcggcgctgttgccgtcaagccagcgccgcaggaggttcacatgcagccaccggttctatccagcgttgatcgccagcgtcttgaggcgatgctgcgcagcccgcagatgttcgacggtgcgccgcgcgccatcgttgacgagagcctcaagcgtgcggtgcaggtacttgaacaatcgaagaccaacgagcaagcaattcgccaggccgcccagcagagcgaggcggcggtacgccaagcgctgagtggcacgcccgatcaaagcgtcgagcagttggatctcaagcgtgaagtgaacaaggagatccagcagttgatcgcacggatcgaagccgccctggccggacctgcgaaatcctgaagccacaggtttcacagcccttgtttcgcaacgttcattgatgaacacggaatacaccgtgcactaaataaggaaattgatcatgccattagtcaacgagcaaattaccgacgcggtcacccagaccaacgtcaaagtagtggccgaatcgccagcgatggcgatgagcaccatctatcagtccatggcgcaggccacggcgattctgttccagaacgccgtgtcggcccaacagcagcaaaacaccctggcccaggcggccaccaaccagggcgtgatgcagatctacagcgtcgataccaccgccggtgcggcggccaccgagaaagtcgcccagggcggcgtgtcggataacctcactagcctcttgaccgtgctcaagtctttccagccttaagcactgagcaataacggaagttgttctttctcaacccaggagtttcaaccatgagtactgtcagcccgcaaatcaccgatgccgtcacccagaccaacgtcaaggtcgttgcagaatcgcccgcgatggccatgagcacgatttaccaatccatgggccaggccacggcgatcctgttccagaactcggtctcggctcaacagcaacaaaacaccctggcccaggcggccaccaaccagggcgtgatgcagatctacagtgtcgacaccaccgccggcgcgtcggccaccgaaaaagtcgcccaaggcggcgtggccgacaacttgaccagcctgttggccgtgctcaagtcgttccaaccttaagctgcagggccacaacagccccggtgcccactaggctccggggctgttgtcgtttgtgcgcttgatctgaaagatgaaccagatgcgccatattcgttctttttttcgaacatcctattgccctatacccccattgatcctaggattcgtttgagatttcaaacgctctgtctcccgtgcgctgtatttttctcccgcgcgctggggctgatttccctgacggcagcccacaaggcgcctttcaacaactctaattcgctccgcgtgcgcgcggtgctgttaaggaaagccgacatgcagctcaaagatacccagttgttccgccagcaagcctttatcgatggcgcttgggtcgatgcggacaacggtcagaccatcaaggtcaacaacccggccacgggtgaaattctcggcagcgtgccgaagatgggcgccgcggaaacccgccgcgccatcgaagccgccgacaaggccctgccggcctggcgtgccctcaccgccaaggagcgcgccaacaagctgcgccgttggttcgaactgctgatcgaaaaccaggacgacctcggccgcctgatgaccctcgaacaaggcaagccgctggccgaagccaagggcgaaatcgtctacgccgcgtcctttatcgagtggtttgccgaagaagccaagcgcatctacggcgatgtgatcccaggccaccaacccgacaagcgcctgatcgtgatcaagcagcctatcggcgtgaccgcggcgatcactccgtggaacttcccggccgccatgatcacccgcaaagccggcccggccttggctgccggctgcaccatggtgatcaagccagcctcgcagaccccattctcggccctggccctggttgagctggcgcaccgcgccggtatcccgaaaggcgtgctcagcgtggtcaccggcagcgccggcgacattggcggcgagctgaccagcaacccgatcgtgcgcaaattgtccttcaccggctcgaccgaaatcggtcgccagctgatggccgaatgcgccaaggacatcaagaaagtctccctggagctgggcggcaacgcgccgttcatcgtgttcgacgacgccgacctggataaggccgtcgaaggcgcgatcatctccaagtaccgcaacaacggccagacctgcgtctgcgccaaccgcctgtacatccaggattcggtgtacgacgccttcgctgaaaagctcaaggtggccgtggccaaattgaagatcggtaacggtcttgaagaaggcaccaccacgggcccgctgatcgacgaaaaagccgtggccaaggtccaggagcacatcgctgatgccctgagcaaaggcgccaagctgctggccggtggcaaggcgatggaaggcaacttctttgagccgaccatcctcaccaacgtctccaaagacgccgctgtcgccaaggaagaaaccttcggcccgctggcgccgctgttccgcttcaaagacgaagccgatgtgatcgccatggccaacgacaccgagttcggcctggcctcgtacttctacgcccgcgacctgggccgggtgttccgtgtggctgaagccctggaatacggcatggtcggcgtcaacaccgggttgatctccaacgaagtggcgccgttcggcggcatcaaggcctcgggcctgggccgtgaaggctccaagtacgggatcgaggattacctggaaatcaaatacctctgcctgggcatctgaccagcaagagcttgcagcaaacgcagagggcacgagagcgctgcccctttgcgtgtttcacatcgttattcgtagtggccgggaaagctgtggcagtcgatcatcgcatgctgccgtagttgcctccccgccacgtatgccttggaccacgccacccgatgagtggcgaatgaggactttatgagcaagaccaacgcttccctgatgaaacgccgcgaagccgctgtaccccgcggtgttggccagattcacccgatcttcgccgaatccgcgaagaacgccacggtgaccgacgtagaaggtcgcgagttcatcgacttcgccggcggtatcgccgtgctgaacaccggtcacgtgcacccgaaaatcatcgccgccgtgaccgagcaactgaacaagctgacccacacctgcttccaggtattggcctatgagccctacgtcgaagtgtgcgagaaagtcgctgccaaggtgccaggcgatttcgccaagaaaaccctgctggtcaccaccggttccgaagccgtcgagaacgccgtgaagatcgcccgcgccgctactagccgtgccggcgtgattgccttcaccggtgcctaccacggtcgcaccatgatgaccctgggcctgaccggtaaagtcgtgccgtactcggctggcatgggcctgatgccaggcggagtgttccgtgcgctgtacccgaacgagttgcacggcgtgagcgtcgacgactccatcgccagcatcgaacgcattttcaagaacgatgccgagccgcgtgatatcgccgccatcatcatcgagccggtgcagggcgagggcggtttttacgtcgcgccgaaagccttcatgaagcgcctgcgcgaactgtgcgaccagcacggcatactgctgatcgccgacgaagtgcaaaccggtgccggccgtaccggtactttcttcgccatggaacagatgggcgtggccgccgacctgactaccttcgccaaatccatcgctggcggcttcccgctggccggtgtgtgtggcaaggccgaatacatggacgccatcgccccgggcggcctgggcggcacctacgccggcagcccgatcgcctgcgccgcggccctggccgtgatgcaagtgttcgaagaagagcacctgctggaccgctgcaaggcggtcggcgagcgcctggtgacgggcctcaaggctatccaggccaagtacccggtgatcggtgatgtgcgtgccctgggcgcgatgatcgcggtcgagctgtttgaagatggcgacagccacaagcctaatgcggcggccgttgctgccgtggtggccaaggcgcgtgacaagggcctgatcctgctgtcttgtggcacctacggcaacgtgttgcgcgtcctggtgccgctgacctcgccggacgagcagttggacaagggcctggcgattatcgaagagtgtttctccgaactctgacacgccccgcccctgtaggagcgagcttgctcgcgaaaaacgcccaggcaccgcgtttcaagggctgcccgcgttttcgttgacgaccttcgcgagcaagctcgctcctacgaaaagcaaaagaaccgcttcggcggtttttttgtgcctgcttcattttacgcacgcggcggcattgtctaaggtgcaagcattgccgatggagcgtgctggatgactgctgttgatttacccgctgtaccccgagtgctgattgccgaagcggacccttggtcgcgggacctgctcaagcaagtgttgttgaatgtgcgttgtgatgcgcggctggatgtgtgcgccgatgggcagcaggccgccacgctgttgcgggaaaaaacctatgacctgatccttgcggactgggagcttgcgggcgtcgatggcctgagcctgctgcgcagcgtgcgccagcagcaccgctcccccgcattgccatttattctgctgagcagccgtaacgacagcgccagcgtacgcgaagccctgcccctggcgccgactgcgtacctgacccacccgctgaacatggagagcctgacccagcgcctgcaagacctgctgcttaacgaaggcgaaagcgtgtattgcgagattccggcgctggcgccaggcatgaccttgccagcattcctggaacggcgccgagaggtctgcgatggcgcgccgttgcgtgtggatgttaaaaccgcggtgcaacgcagcctggggcccgagggtctgcacctgcagcagctcgaagaccaggtgcgtatcgacccgcaaatcaacgccgtgctgatcgccgccgccaacagtgccgggtatcacggcacgccggtgcagactctgcacgcggccctgaacaagctggtccccggacaaagcatgaacctcatcctgggcctggcgctcaagcacaacgtggtgctgggtgaccctgggctgttggcttacgccgagcggtactggcagttgtccgaggacagcgccgagtacgcccgacgcctggcgcgcatgctggaactggatcaccagcgctgctatagcgcctgcatcctgcatcggttgggcgacctggccttgttgcgctgcctggaagactggcgccaggctggcggcgccctggatgacgaagcgatcggcgaatccctcgacacttttggcgccgcctacggctcggcgttgcgcacccgctggcgtttgccgctggagttgcgccaattgatcgcggccacctattcactggaaggcggtgtgtattcacgcgaagccttggtggtgaacctggcgacacagatggcgcggttgaccgagcatgaagggctgcaagagcttgccagcagcaagaccgcacggctgctcaaagtgggcttttccgaactgacaagagtacgcaaaacctgacagccaatgagaccaaatgtgggaggggggcttgccccctcccacattttgcccgagtctagcctgcgataacgcggttcttgcccagtcgcttggcctcatacatcgctgcatccgcccgggcgaacaggctgtcgagggtggagtcatcctcgcgcaagctggccaggccctggctgacggtcacgttgaattcgcggccctcatagctgaacagcaacgcctggatctccttgcccagccgttcggccacttgcagggccatctccggtgcgcaaccgggcagtacggcggcgaattcttcgccgccaatgcgcccgaacaggtcgccacggcgcagtaccccgcgaccactctcggcaatgcgccgcagcacctgatcgccctccaggtggccgtaggtgtcgttgatgtccttgaagtcatcgatgtccagcaacaggaacgccagcgccgtgccctgcacgcaggcgttgtcgaacgcctggttggcgcattcgaagaagtgccggcggttgctgctttgggtcagcacgtcggtggtggcgaggcggtgcagttccagctccagcagcttcttctcggtgatgtcttcggccatgccgaccacgatcagcggctcgccaggcaccacctgctggttgatgtagcacttgtcgcacagccagcggatttgcccgtcggcggtgatgatgcggtactcgcggtcttccacggcgccctgttccagcacgcgggccaggctgtgttcggcgtagtcgaggtcttcggggtgaacactgttgcgccattcccggtgatcggccagcagcaagccggctgaacggccaaagatgcgctcgtaggccgggctcacatacagcacgcggcgcgtttcccagtcgatggcccatagcaccgcgttcacgctgaccaacagcgaactgagcagttgctcacgctcactcagtcgctcgacttcgccctgggcatgcatcaacgccaacagggtcgccgccgcggccgggcgcggcggctcggcagtaggcacatcgggcaggcagggcttttcgtgaaccatcggtacaactctctctgggcgcgccgcaggatggaacagcggtcactacaaggggtcaccatgatggcgaagtgttctttgagagaggggaattgcggtgaagttccatgatcgtgaccgattggcggtgcccgtaaaatggcgccaaaaagccagtgcgcgggagggcaagccctcccacactaccgtcacaccgctgcagggcgcagcgaataggtcttcaattggtgggcaaaatcgcgtagggattggataccgctggcctctgcctcatgcacccactccttgatcgcagccagcatatcgtggccattggtgctggtcttgagccagatctgctggagcgccaggcgcttttcgtagatcaccgtcagcgcatggctgtgctccagcatgctctggatgcgcaggtggtggcggtcatcgagcaagctggtttcccgcgacaacaggcgcttggcccggtggaactggtggcgtaccgaatgatcgaccttctccagctcctgcttgaccagcgggccaattaccaatttgcggtattgggccatgatctggaagcggttgttgaggatcgccatggcggtgtccatgtccaggctacccttgccttcgacgcggtgggcaatgggcgccacgcgctgcaccttggccaggcgcaggaagctgaacaccttgatccacgcccaacccaggtcgaactcccacttcttcaccgacagcttggccgagttggggtaggtgtggtggttgttatgcagctcttcgccgccgacgatgatgccccacggcaccaggttggtggcggcgtcacggcattcgaagttgcgatagcccacagcatggcccaggccgttgatcacgccggcggcccagaacggaatccacatcatctggatcgcccagatggtgatgccgatggtgccgaacagcagcacgtcgattacgcccatgatcgccacgcccagcagcgggtagggcgtatagagcttgcgttcgagccagtcgtccgggcagttcttgccgtagatgcgcagggtgtcggggttttctgcctcggcgcgatacagctcggcacctttgcgcaaaacggtggacaggcccttgatcaccgggctgtgcgggtcatcgacggtttcgcatttggcgtggtgcttgcggtggatggcggtccactcgcgggtgttctgcgccgtggtcagccacagccagaagcggaagaagtgtttaaggccggcattgagctccagggagcgatgggcggaatagcggtgtagatagacggtgaccgcaatgatggtcacgtgggtcatcaacagagtgactgccaccagttgccaggctgacagatcaagaaaaccgttgtaccacataggctgtatggccctcagataaagaaaaaaacagcatccgcattatcacttcctttgcagataaaaccagtggctgtttcagataaggcttacaaggtgtttcctcatctataatcctgatcctttgtagggcgattctggttatttagtaaggattactaaacatatgctgttttcataccgaggtgccctacgtgcggggctggtatacctgctggtttccatcgtttggctccagctcagcaactacgcattgatcaactttatcgatgagccgtgggagctggggcgctggctgcagatgcgcggttatgtgtgggtcagcctcagcgcgttagtcatttactggatcggccggcgttttgcccgtgcccatgcgttgcagcagcccctgaaagaaaaccgcgagcgcctgcgtcaggccgctgcggtgttcgattgcacccgcgaaggggtgctggtcaccgatacccaagggctgatagtgcacgtcaaccgggcgttcatagagatcactggttatcgccgcgaagacgtcatgggccagcgaccaagcctgttcaaatccggccgccattcgtcgactttctaccagcaaatgttccagacgctggaacgcacgggcgaatggagcggcgaaatctggaaccgacgcaaaagcggcgaaatttacccacaatggcaaaccattcgcgtcatccacgatgaccagggcaaggtcagccactacgtcgcggtgttctcggatatcagtgccatcaaggactccgaacacgaactggcgcacctggcccaccatgacccgctcaccgacctgcccaaccgcctgctgttcaccgaccgtgccgagcaggccctggcctcggcgcaggtacacaagcgtggttgtgccttgctgctgatggacctggaccacttcaagatcatcaacgacagccttggccataacgtcggcgaccagttgctcaagctggtcgccgaacgcttgcgcggcttgttcgggcccggtgtgaccctggcgcgcctgggcggcgacgagttcgccgtgctggcggagagttgtccacaggtgctgcaggccgcagccttggcacagcgcatgctcaatgccatgaaggaccccttcatttttgacggcaaccagctgtttatcagcgccagcattggcatcagcctgtttcccagcgacgccctgagcgccgagcaattgctgcgcaacgccgactccgccttgttcaaggccaagaacgccggccgcgaaggctacgccctgtacaccgaagaactcaccgcccatgcacagaaccgcgtggagatcgccagcgagctgcgtcgcgctctcgaccagcaggagctgcgcgtctattaccagccggtacacgacctgcaggacagccgcctggtgggcgtggaagcgctggtgcgctgggaacacccggaacgtgggctgataccgccgggcgaattcatccccatcgccgaacgcaccgggctgattgccgacatcgatgggtgggtgatggaccaggcctgtcgccagatgtgccagtggctggccgacggcgcgccgctgagttttattgcggtgaatgtctccagccgcttgttcgcccggcgcgagctgtacgagcaagttgcccaggtgctgcatgccactggcctggatccggccttccttgaactggaagtcaccgaaagcgcggtgatggacgacccggaagtcgccttggagcaactgcaccgcctgcgtgaactgggcctgcgcctggcgatcgacgactttggcaccggctactcctcgttgctgcggctcaaacgcctgccggtgcagaaactcaagatcgaccaaggttttgtcgcgggtttgccctgggatgaagacgacgctgcgattgtgcgcgtggtcatcgccctggccaaaagcatgggcatgcaggtgcatgccgaaggtatcgaacaggtggagcaggcgcgcttcctgctggaccagcagtgcgatatgggccagggctactggtttgggcgaccgatgccagccgacgctatcgactggacccgagcgccctcaatccagacttgaaatgcagtcaaaatgtgggagggggcttgcccccgatatcggtgggtcagccaagtttttctaacctgatacaccgccatcgggggcaaaccccctcccacatttggatcgcaaccacacgcaaccccacgtcctgtcagaaaattctttctggttatataaacattcttaaatagtatttttaagaatatccgcgcttatctactatcgccctcacgccgcaagcagtgccgccactgccaggcactattcatttcaggagcgagaccatgagcgcatctctacgtagcgtcgacggccaggacgaagcaaccattttgcgtgagatccagagcgccctgcgcgatctgcggtttggcgcagtggaaatcaccgtgcacaacgctcaagtggtacagatcgaacgcaaggaaaaattccgcctgcagaacccgggtaacaaaccgagctgagcaagaacggcgatagacccgcaactataagaaaagccaacactcaagaattttcaggagcttctatgtcgtcgattcgccgttacgccctggccgcgttggccagtgccgtgtttgccggttccgccgttgccaaggactacgagttgctcaacgtctcgtacgatccgacccgtgagctgtaccaggactacaacgccgagttcaccagcttctggaagcagtcccaccccggcgacaacgtcaagatccagcaatcccacggcggttccggcaagcaaggtcgggcggtgatcgacggcctgcgtgccgacgtggtgaccctggccctggccggcgacatcgacgaaatcgccaagctgggcaagaccctgccggaaaactggcagacccgcctgccggacgccagcaccccgtacacctcgaccatcgtgttcctggtgcgcaagggcaaccccaagggcatcaaggactggggcgacctgatcaagaaagacgtatcggtgatcacgccaaacccgaaaacctccggcggtgcacgctggaacttccttgccgcctgggcctacggcctcaagactggtggcagcgaagccaaggctcaggaatacgtgaaagagctgttcaagcacgtcccggtactggacaccggcgcgcgcggatctaccattaccttcgtcaacaacggtcagggcgacgtattgctggcctgggaaaacgaggcgttcctggcgttgaaagaagacggcggcgccgacaagttcgacattgtcgtgccgtccctgtcgatcctcgcggagccacccgtggccgtagtcgacaagaacgccgagaaaaagggcaacaccgagatcgccaccgcgtaccttaatcacctgtacagcccggctggccaggagattgcggcgaagaacttctaccgaccacgggatgagaaagtcgccgccaagtatgcccagcagttcccgaaactggaccttgtgacgatcgacaaggacttcggcggctggaaaacggcccaaccgaaattcttcaatgatggtggcgtgttcgaccagatctacacggcgcagtaagccaaattacctgtaggagcgagcttgctcgcgaagatcttcaacgataacgcgtacaggctgaatgagcgcggtgcctttgagttcttcgcgagcaagctcgctcctacagtagtgtttaccctttaaccaaggactcttatgtcgcgtcgcatttcccccgtcatacccggcttcgggctgacgctgggctacaccgtcgtgtacctcagcctgatcgtactcatccccctggcggcgatgtttgtacacgccgctcaactcacctgggatcagttctggaacatcatttccgcaccgcgcgtgctggcggcgttgaagctgagcttcagcaccgcgctgtacgccgcgctgatcaacggcgtgatcggtacgctgctggcctgggtgctggtgcgttacaccttccccggtcgcaaggtcatcgatgcgatgatcgacctgccgttcgccctgcccacggctgtggcgggtatcgcgctgaccgcgctgtacacgcctaacggtttggtcggccagtttgccgccgacctgggtttcaagatcgcctacacccccctgggtatcaccctggccctgaccttcgtcaccttgcccttcgtggtgcgcacggtgcagccggtgctggccgatatcccccgggagatcgaagaggccgcggcctgcctcggcgccaagccgctgcaagtgttccgctacatccttgtgcctgcgttgttgcctgcgtggctgaccggcttcgccctggcgtttgcccggggggtgggtgagtacggttcggtgatcttcatcgccggcaacatgccgatgaagaccgagatcctgccgctgctgatcatggtcaagctcgaccaatacgactaccgcggcgccacctccattggtgtgctgatgctggtggtttccttcattctgctgctgctgatcaacttgttgcagcggcgcatcgaacgtccataaggaggcgcggaacatgtcccaatcgtctatttccgccgcgtcctcggccaatgccgcccggcgtggcagtgcggtgtcgcgacgcatcctgatcggccttggctggctggtgttcgtactgtttctgctgctgccgttgctgatcgtggtaacccagggcttgaagaatggtctgggtgcattcttcactgcgatcctcgagcccgacgcgctgtcggcgttgaagcttacggtgattgccgtggcgatttcggtgccgctcaacctggtgttcggtgtcagcgccgcctggtgtgtgagcaagtactcgttccggggcaagagcatcctggtgacgctgatcgacctgccgttctcggtttcgccggtgatcgcgggtctggtctacgtgctgatgttcggcgcccagggcttcttcggcccatggttgcaagagcacgacatccagatcgtgttcgccttgcccggcatcgtgctggcgaccatcttcgtcaccgtgccgttcgtggcccgtgagctgatcccgctgatgcaggagcagggcacccaggaagaggaggcggcgcgcctgctcggtgccaatggctggcagatgttctggcatgtcaccgtgccgaacatcaaatggggtctgatctatggcgtggtgctgtgtaccgcgcgggccatgggcgagttcggcgcggtgtcggtggtgtccggccacattcgtggggtgaccaataccctgccgctgcatgtcgagattctctacaacgaatacaaccacgttgccgcgtttgcggtggccagcctgttgctgatcctggcgctcttcatcctgctgctcaagcagtggagcgagaaccgaatcaaccgcctgcgcaacagcgccggtgaggaataagtcatgtcgatcgaagtccgtaatgtcagcaagaacttcaacgccttcaaggccctggacagcatcaacctggatatccagagtggcgagctggtggcgttgctgggcccgtccggctgcggcaagaccaccttgctgcgcatcatcgccggcctggaaaccccggatgccggcagcatcgtgttccacggcgaagacgtctccggccacgatgtgcgtgatcgcaacgtcggctttgtgttccagcactacgccttgttccgccatatgaccgtgttcgacaacgtcgccttcggcctgcgtatgaaaccgaaaaaccagcgcccgagcgaaagccagattgcggtcaaggttcacgaattgctgaacatggtgcagctcgattggttgtctgaccgctacccggaacaactctccggtggccagcgccaacgtatcgccctggcccgcgccctggcggtggagcccaaagtgctgctgctggacgaacccttcggcgccctcgacgccaaggtgcgtaaagagctacgccgctggctggcgcggctgcacgaagacatcaacctaacctcggtgtttgtgacccacgaccaggaagaggccatggaagtcgccgaccgcatcgtggtgatgaacaagggcgtgatcgagcagatcggctcgccgggggatgtctacgaaaacccggccagcgatttcgtttatcacttcctgggtgattcgaaccgcctgcacctgggcgaggataagcacctgctgttccgcccccatgaggtgtcgctgtcgcggcatgagctggaggatcaccatgcggcgcaagtgcgggatattcggccgttgggcgccacgacgcgggtgacgctcaaggtcgaaggccaaagcgagctgatcgaggccgaagtggtcaaagaccatgacagcctcacaggtttaacccgtggcgagaccctgttcttcaaacccaaggtctggcaaaaagcctaaactcaccgcaaagccaaatgtgggaggggcggtgcgacgattcgacttgctcccgatagcagtggatcagccagaatatttgtgactgacacaccgccatcgggagcaagccccctcccacatttagacttcacttggcttgagatcgcggcgtcccaccgggcctgaacgttgttcaatctgcttttgcaggtcctgccgcaaccccaccagaaacgccaactccgccaccacaaacaacggccccacaatcagccccgacacatcgtccacaaacgcgggtttcttgccttcgtagtaatgcccgacaaactgaatcacccagcccacaacaaacatacccacgccactgctcagccataccatcgtgctctgtgccgccaatacatgcccggcccacaccgacaggcccatcagcaccgtcatcagcacgcccagggccagttccaggcgcaggtagaaccacgccgagaataacgccacgagcatcgctggcgagacccacaggccacccaccgtccattcggggcgtgacagcagcacggccacggcaaccacgatcaatgggataccgataaagtggctgacaatattgcgcgggtcgcggtggtacgcggcgtattgactgaggtggtcgacgaggcttttcattgttgttcctcctgtaggatgtttgatcatgccctttcagtcggtgcctaactgtcaactgggcgacaatcttcggagctcccatggacacagggatatggcacgcgcacttggcccgcggccattggttcaaacacttgccgccagacttgcagcgtagcctgctgggcgcggcgcgcgtgcgctcattgacggcggggcagtttctgttcaagcgcggcgacccgccgtgtgggctgtatgcggtgctggaaggggcggtgcgtatcagcgcggtcagtgcccagggtaaggaagcggtgttgagcctggtggaaacaccgcactggttcggcgaaatctgcctgttcgacaacctgccacgcacccacgacgccctggccacaggcgcgtgcacactattgcaggtgccgcaggcggcgatgctcgacattctcgaacagcatccaatgttctggcgcgatatggccctgctgatgagccataaactgcgcttgtcattgatcaatatcgaacaaatcagcctgatgcccgcgtcggtgcgcctggcccatcggttgctgatgattgcccagggctacggtgaaatagagccgccgcgccgcgtgttgcagctgccccaggaagatctggcggcgatgctcggcctgtcgcgccagaccatcaacagtctgctcaaggcgctggagcaacagggcatcattggcttgagttacggcgccatcgagatactcgacctcaaccggctgcgcctggccgcgggcctatgaaccgcgatacgtggagaaaccgtaagggctgagcaacagcgggatgtggtaatgctggtcggcctgtttgacttgaaaaatcaccggcacctcggggaagaacgtctcgcggttggccttcttgtagtagtcacccgtcttgaataccacgcggtattcgcccggcgtcatgctgcggtcggcgggaaacagttcggcgatgcgtccctgctggttggtgacgcctttggacagcgcctgccagtggtcgcccacctgctgttccagggtgacgctgacaccggccgaaggcaggccgttttccaggttgagcacgtgtacgctcagcgggttgccggcggccagggccaggttgcacaggccgctcaggctgagggcggcgagggtcatgctgagggttttcattggaaagtccttttgatagaggtcaagtcagggggtgattttcaagcccagttgctcggcagcctggacggcacaggcttcgtcctgcgcagcgccaccggccccggcgatgcccagcgcaccgaccagttcggcgtcagcgaacagcggtatgccgccgccgagcaacagcaactcgggcaagctgttaaggttggcggcctcggggttgttgcgggctcgctcggcgaatagccgtgtcggggttttagtcgacaacgcggtgtacgccttgcgttggctggcgaggctgttgtgcgggccgacaccgtcagcccgcaggcccagcagcaggttgccgccgcgatcgagtaccgtcagagcagccgtgcaatgggccaggctggcgtcggccagttggcgtgcggtgcgcagatccagctcggcgtggcgcggcagttgtggcgtggcctgggctgcggtggccacggcaaggctgaggaacaaagcggtgcgatacatgcgaagagctccagaaggcaggccatcacggtagccagtggacgcggacaaaagccgcacaattggatgacaggtttgtaatcaaacccagaggtaagacatgcaggtgttgttagtggaagaccagccgcaactggcccagcgcatggcccagggcctgagcgaggccggcttctcagtggaagtcgcggccaacggcatggcggcgcagcggtttgtggaaggcaccgagtacgacctggtgatcctggacgtgatgctaccgggcttgaacgcctggacattgcagcaggcgattcggcaaaagggcgacacgccggtgctgtacctgaccacaccgggcggcattgaagaccggttgcgggggttggaactgcatgaggatgactacctgctcaagccgtttgacgccaaggtgttggtggcgcgggtgaggaaagtattgcgccgggatcgtgggcgctgattgccttagcgaccgctatcgggagcaagccccctcccacatttgaccgcgctcatagttcagtgtgggagggggcttgcccccgatgaggccatcccagccactgaaaatcttcctaccgcaacccatcccgaaactgccccggcgtcacccccgtccagcgcttgaacgcccggttgaaactgctggtatcggcaaaccccagcaaatggctgatctcggccaacgaacactgcggatccctcaggtgcaacaacgccaggttctcccgacactcattgagcagcgcatcaaaccgacagccttcatccgccagatgccgctgcaagctgcgtaaactcaggtgcaaggcctgggcaacgcgttcggcactcggctcgccatcgggcaattgcgcctcgatgacggcgcgcaccttgcgctcccaagtcaacggttgcagttgggcgagggtgcgcttgagcacggtttcgttgtgttcggccaactccgggttggcatcgtcaagatgactgtcgaagtcgtgggcggcgaactccaggcgatcttcgtcggcggcaaaagacacgggagagcgaaacaccttgtgccatggctcggggtcgacaggctgcgggcgccgtagataaacggccagcggcgcatagtcacgccccaggcggttgcggcaagtgcgcacgtagattgccgcgaaggcgtcgatggcctccagcgccggcgcggggctgccttggggttggagcaggcgaaagtggtagacgtcaccgtggcggctcagctccaggctcagggcatcactgaccacttggtgatagcgcacgatacgttcgaacacctcgcgcaagctgccgctggccaccagggcataacccagcgcatgaaatgtcgtggggctgacaaagcgcgacacccgcaagccaatcgccggatcaccgctggcctgcaccgccagttgccacaggcgcgtggtcgccgacaacggataacgtgcgttggggtcgtccatctgctgcgggtcgaggccggcctcggcgcacagcgcggcgctgtccaggcccagggcgtcgagctgcttgcgcagggcgcgggtccaactggcgagggaagtgggttcggtcatggcgattggcgcttgcggtcaacaggttggcgtccgaggctagcgtcctgcccgatcgcttagggcaggatggacacatcaatgtacaagaggatggaagcatggacggtacttctgcaagtccccaacagatgaacgcacaacaacgttcagcgcatatccgtgaggtggtgctggccgagggcgcccgattgcgccagcgccacccctggctgctgcatcaggacgccctgggcgccggcatcctggcgtttgccttgctcggcatgctcggctcggcggcgctctatatcagtggtcacctggcctggtgggcgtgcctgctgctcaacgcgttcttcgcttcactgacccacgagttggagcacgacctgatccacagcatgtactttcgcaagcagcgcctgccccacaacctgatgatgggcctggtgtggctggcgcggcccagcacaatcaacccgtggatacgccggcatctgcacctcaaccaccataaggtctccggcactgaggccgatatggaagaacgcgccattaccaatggcgagccctggggatttgcgcgcttgctgatggtgggcgacaacatgatgtcggccttgatccgcatgctgcgggccaagacctgggcgcacaaactcagcatcctcaagcgcgtggtgctggtgtacgccccgctggcgctgctgcattggggcgcgtggtatgtctttctgggctttcatgccgccaacggcatcgccaatctgttgggcgcgccgatcatgtggtcggccggcgccttgcagatgatgcaggtgatcgacatcgctgcggtggttatcatcggccccaatgtgttgcgcacgttctgcctgcattttgtcagctccaacatgcactactacggcgatgtggaaccgggcaacgtgatccagcagacccaggtcttgaacccctggtggctgtggccgttgcaggcgttctgcttcaacttcggcagcacccatggcatccatcactttgtggtgaaggagccgttttacatccgccagatgaccaccagggtggcgcataaggtcatggctgagatgggcgtgcgcttcaatgatttcggcaccttcgcccgggccaatcggtttgagcgccaggaacagccggacgccaaactcgctttcagcaagcaatgaacgccaggggcaggtcgcggatctgtgcgcgcacgggcggctgatagtggtcgtcgctggtcagctcatgcagcagttcttcgcgtaactggtggaattcgaaactgctgcgctggcgcggatggggcagggcgatctctaccacctgcttgatacgcccgggccggggctccatcactaccacgcggtcggcgaggaaaatcgcttcttccacgtcatgggtgaccagcaccgtggtgatcttggcgcgggcgcgaatggccaggagttcgtcctgcatctgctggcgggtcagtgcgtcgagggcgccgaagggttcgtccagcaacaggatgcgcgggctggccaccaggccacgggcaattgccactcgttgggccatgccgccggagagttggtgggggtaggcgcgggtgaaatcagtcaggcccaccagctcgatgaaatcgctgatgcgtcggttacgctcggcctcgtccaggggctcgttgaccaggcccaggccgatgttttgcgccacggtcagccagggaaacaggcgatgttcctggaacacgatgccacgttcgccgccgataccgctgacggccttgccatcgacctggatctggccgcgaaactgcgtatccagccccaccagcaaacgcagcagggtggacttgccgcaaccgctggcgccgacaatcgcgacaaactcgccttcggcaatctccaggttgaattcgcggatggcttccagttcgaagccgtcgacgtcgaagctcttgcccacatggttgaagctgacaataggtgcgttcatgcgtgtctccagcgggtggcgcgggtttcgatgcgttggccgatcaagttgaggagggcgccggtgaagccgaccagaagcatgccgcccatgatcaggtccatgcgcagcagttgttgggcgccgatcatcaggctgccgatgccgccattggacggcatgaaatattcggcgccgatggtgcccatccaggcgtagatcaagctcaggcgcaggccggcgaaaatacccgccgctgcgcccggcagtaccaggcgacgcaggcgttgccacaggttcaggcgcagcacttgagcggcttcgcgcagttgcggcgacaggttgagcacgctgcgctgggtggcgataaacaacgggaagaacgcggcgagggcgataaacacccacttggccagttcacccaggccgaaccaggcggtgagcagtggcacccaggcgaaaatcgcaatctggcgcagcgcagccagcgtcgggccgagtagtcgctcactgcgccgcgacaaccccagccacaggcccagggcaaagcccaggctaccgccgagcagcaagccgcccacggcccggccgaggcttttgcctaaagccgcgctcaggctgccatccagcacaccggccacggtggtttgcagcaccgcccaggggctgaccagaatattcgggtcgacccagccctgttgtgtcgccacctgccacagcgccagcaacagcagcggcaacagccagggttgcaggcgttgccagccttcatagcgcggcccgcgccggatctgcgccgtggccggatggggccagtgcacccatttgcgatccagccagccgatgccgcgatccatcaccacgcccagcacgccgatgaccacgatgcacacgaagacgatatcgagcatgaacaactggcgtgcccataccatcaggtagccgatgccttcgctggaggccagcaactccacggccaatagcgacgtccagcccgccgccagggccaggcgcaccccggccatgaacgccggcaacgcggcgggcaggatcaggcggcgaatcagcaagtgggtgggcaagcgcagcacacgggcggcttcgcgcaggttgggctgggcgtcgcgcacgcccaccagggtatgcagggtcacgggcaccacgatggccttgatcagcaccaccagtttcagagtttcgccaatgccgaaaaacaccatgaacagcgggatccacgccagggtcggcacttgcgacaacgcgctgaacgtagggaataccaggcgctcggcgcgggcgctgaaacccaggctcgcgcccaatagcgcaccggcgccgataccggccagcaggccccagaacaaacgttgcaagctgattgccagatggctccacaactcgccgccggccagctccacggcgctgctccacaccagggcaggggttggcaggatctgctcgctcatccagtggttgcggctggccagccaccacagggcaaacagcccgagcggcagcaaccagggcaacaggtgttcgctcagttgcggccaacgctgcgtggcgcctttggacggggctgccagaggtaggctcaaaagtgaaatccgggccatgaaagacctccgctggtgccaaatacgttatgtgatttcggtcttacaaaagcgtaatcaagatgattgcgagataagagaaatcatttaaagcctcagccctccaggcatccaatgcattcgaagaatattttcgatgctgttcatgcataacgccttggagcctgcgtattcgcttgcatagtcctaaaagctattaaattgtgaatttatagtatttaaagttttgtacggcttgtgcctactttctgctccccaggcgaccgtcgcccaccaggagctgtgcttatgaaattgcccttcaaacatctgatcagcctgttggccggcaccgccctggccgggctggtgcaggccgctgacctcaaggaaatccgcattgctgtgcccgacctcagcgctggcagccagcacagcggcggtggcatcaccgacgtgttgcgtgaacagcagatctttgaaaaagcctttgccgaccagggcatcaagatccagtggaattacttcaagggcgcgggccctgtgatcaatgaagccttcgccaacggccaggtggacctcgcctatctgggcgacctggcggcaatcatcggccgttccaatggcctggatacgcggctgctcagcgccacagcccgtggggtcaagcactacctcggcgtggtgccgggttcaggcatcaagaccctgcaagacctcaagggcaagcgcgtggcggtgtttcgcggcacggccagccagttgtcgttcgacagtgcgttggccagccagggcttgagtgagaaggacctgaaggtcatcaacctggacttcaatgccgccagcgctgccctggccgccaagcagattgacgccacctggggaggctccaccctgaccgcgctgcaagccaaaggcctggcggaaataccgctgaccaccaaagacctcggcgatgccggcagtatccaggccgtgctggtgggcagcgccaaatttgtcgaccaacaccccgacgcggtggccaagttgctcaaggcccagcagcaggcggtgcagtggctgaccgatgacaacaacaaacaggcctatatcgcgctggtgtcggggctggccagttacccgccggtgatcctgaccaatgatttgaaagaccagaaactcagcgagattttcccctcgaccctggacccggtgttcctgggcaaattgcaggatgcggtggatttggcgtcgaaggagaagctgatccgtcgctcgtttcaggtgagtgattgggtggcgcctgggttggcggcggctgggctttgagcttatcggtgcctgggcgattgctatcggaggcaagccccctcccacatgggaacgcattccaagtgtgggagggggcttgcccccgatagggcccttcaaaccgccacactcaccacctgcctgtccacctccaccaacgtctcaatcatcgccttcgccgccggcgacaaccgcgacccagtgcgactgacaatcccgcaacgcgcactcatggtctccatattctgcggcaggttgcgccagtgcagcagcaccagcgaaccgctggccacatcctcggcaaaggcttcctcggtgccgacgccgatggcgttggactgcagcacgatcttcaccagcgccgggaagtgttcggtctggatgctcggggagaaatccatgcgcccgctgaggttcgccagcagtttgcgaatgccttgggagatcaacggcgaggccagcggatagtcgaacatgtcgttggtcgacaggctgtccttggccagcagcgggtgcccagggcggcagaaaaagacgccgcgtttgggcgtcagtgcgcgggtctggaaattcgggtcggcctcgaactgacggatgtcggcgataaagaattcgatctcttcacggctcaggctgcggctgagggtttcccagttatccacctggaaactcgtgcggattttcgggtgggcgttgataaatcgcgccaccgcatccggcaccaacttcaccgctggcgccgggccgcaaccgaagcgcaggtcgccggcgtcgagcttggtcatgcgcgtcacttcactgctcagcagcgccgcgccgtgtaccaggctcagggcgtgctgcaacaccacctggccttccggcgtagggcgcaggtccttgtggccgcggtctaccagcacgcagccgaactcctgttccagcccctggatgctgcggctgaacgccggttgggtgatgcccatggcgtccgctgcacgcacgaaactgcggtgttcgttgagggcgatgaagtagcgcagttggcgaagatccatatgctttcccggcattttaaaaataggtcgaaggcatttgcgaccgagcaagctgaggttttaaatgcaagctcttattccgtcaacgaagcatcgattcatttgctagatctaaattgcatatgaatagagcgttgctggaaagcatctccaccatcagcaggcacatgagggtcatcacaatgagcaacgccgcattagctgttcaacccattgcccacgcgctcgacatccacccggtggccgggcgtatcggcgccgagatccgtggcatcaaactgtctggtgacctggatgccgccactgtcgaggccatccagcaggcactggtgcagtacaaagtgatcttcttccgtgagcaaacccacctcgacgaccagaaccaggaagccttcgcccacctgctcggtgagccgattgcacaccctacggtgccggtgcgcgacggcacgcgctttctgatggaattggatggcacccgtggccagcgcgccaattcctggcacaccgacgtgactttcgtcgatgcctacccaaaagcttcgatcctgcgttcggtgctggcgccagcgtccggcggcgacaccgtctgggccaataccgccgccgcttacaacgacctcagcgtcgagctgcgtgcgttggctgaccacctatgggcggtgcacagcaacgagtacgactacgccgcacgcaagccggatgtagcggtagagaagctggaggaataccgcaaggtcttcacttcgacagtgtacgaaaccgaacacccggtggtacgcgtgcacccggtcagcggtgagaaaaccttgctgctggggcacttcgtcaagcgcctgaaaggctattcccaggcggagtcgacccagctgttcaacctgctgcaaggccacgtcacccgcctggaaaacaccgtacgctggcgctggaataccggggacgtggcgatctgggacaaccgcgccacccagcattacgcggtggacgactatggcacccaggagcgcatcgtgcgtcgggtcacgctcaagggtgatgtgccggtgggtgtgcaggggcagcgcagccagaccacgaaaggtctctaagccggttggagatcaaaatgtgggagggggcttgctcccgatagcggagtgtcagtcacagcatctttgactggcccactgctatcgggagcaagccccctcccacatttagtcctgtaccgttctaccagaccccgatctgcactactttttccgcctccggctcaccataccgaaaccattgcccacgcacttcaatctcggtgtggctgatggtggtacgccgcttcaacccacgcagccattcgaacagataacccaagtgagtctcccgcacctcggcgtacgcaggatcgctgcccaggtcgtggacttcctgcgggtcattttccaggtcgaacaactgcgggcggaagccgtcataggccaggtatttccagcgttcactgcgtaccatggtcatgcggcaacggtcgatgggctgcgccaggcgttcccgggccggggcctggaaggcgtagtcgtattcggcaatggcgtagtggcgccaggtgggttgctcgccgtgcagcagtggaaccagcgagcggccttcgaggcgatggtcggcggcgggcaggcccagggcgtcgaggaaagtgggcagggcgtcgatggtttctaccaggcgtgcgtccacggtgccacggctgatatcggcactggctcgcgggtcgcgcacgatcaatggcacgcccacggcgggctccagcaaaaactctttttcgccgaggtaatgatcgccgaggaagtcaccatggtcgctggtaaacacgatcagtgtgtcgtcccagcggccagtgctttgcatgaaatcaaacagccgcccgagttgatcgtcgatctgtttgatcaggcccatgtaggtgggaatcactgtgaggcgcactgcgtcgcgggagaaattcacgctctcctggtgttgacggaatgcctggtataccgggtgatcgctggtttgcccaggttgaatgggcgcctggatatgctcggcaccgtacagcgcgtgatacggcgccggcgcgatgtagggccagtgcggcttgatatacgacaggtgcaggcaccatggctgttctgcttgttcgctgatgaagtcgatggcgcggtcggtggtgtagacggtttccgaatgttcctcggccacccgtgcaggtttgcctgcgttgcgcatgtgccagccgctgaggatctcaccgtcttcgccttgggcggcattggcccattcatgccaggggttgcgaccaccgtagccttgctcgcgcaggtagcgggtgtagggcgcggactcgcgtttgtcgtcgaacagcgggctgtcggggtagatgccgtcgtggcgcaaatatgcgtcaaagcccacctcattgagcggctcggcctgggcgctgtcggggtctatatgcaggcggtgcaacgcctccaggttcggcgtggcgtgggtcttgcccaccagtgcggtgcggatgccgtgagggcgcaggtaatcaccgatcgtcagttcttccagcggcagcggtacggcgttccacgccacctgatggctgctgacgtaacgcccggtataggccgacatgcgcgacggcccgcagatggtgccttgtgtataggcccgactgaaacgcacaccggcagcggccaggcggtcgatattcggcgtgtgcagatgggcatggccgtagcacgacagatagtcgcgacgcagttggtcgcacatgatgtagagcacgttgcaaacaggttttggttcagacatggaggttcaccgaacggaggacaggtgggttttttcgccgttcgaggggcgctctggcaagtgcatttggggactgggttccatgcagtgaatgcatggggcttgcccgcgaaggcgccggttcagacagcaatattttcaagtgtgcaaatgtcttcatccagctcatcaatctgcttgatctgctcaatcatcgcctccgccaacggcgacaaccgataccccgcacggctgacaatcccgtagcgggtgtaacgctcctccaggttttcatccagcccctcaattctcaggcacaccagctcaccccgtgccatatgcagcacatcactgttggcgctgacgatgccgatggcgtccgaacgcagcaccacgcccatcaggctatagccgttttcacattccacactgggttggtaatcgggccggccgctgaggtcgacgatgactttgcgcaggttaggcgggcggatggtcacggccagggggtagctcatcagctcggcggcgctcacgctgtcgcgcccggccaaggggtggccggcacggcagcagaaataccagcggcgtgggcgcaggcggtgggtgtggtagtcggggttggcttcgaagtggcgggtgtcggcaacgaaaaattcgaactcttcgccgagcaggcgcttgtccaggctttgccagtcgtccacctggaactgtacgcgggccttggggtagcgcccgataaaactgccgatggcgcgggggatcaagccacctgccggcgccgggccgcagccgaagcgcagctcaccggcttccaggccgttgaactggttgatctcgttggccagttgctgggcgccgctgaccagtcgccgcgcatgttcgagcaatacctggccttgcttggtgggcgccaggtccttgcggccgcggtccaccagttggcagccagcactgtgttccagggcctggatgctgcgactgaacgctgactgcgacaggttcacggccaccgccgccgcgacaaaactgcgttgttcggcaagggcgatgaagtggcgaagctggcgcagatcgatatgcatttttcacattgaaaatatccgggaaatgcattggctatgcattaggtcgactccttataaaggctatctcttatgcagtaaatgttcgttaaaacataaataaataacctttaggaatatctgccgatggatatctccgggttctggagccgcttatgagtctgttcaagtcattgcccttggctgtgttagtggccggtagcagcagttggtcgccgacccaggccgcagaaacccctgcgcctgccagcaagggcgacagcgccagtggccagttggaaaccgtcaccgtgaccgccaggcggcgcaccgaaagtgcccaggccgtgccgacgcccatgagtgtggtcggcggccaggcgctggagacccagcgggtgtaccggatccaggatttgcagcaactggtgcccagcgtcaacgtcgcttatatgcatgcgcgtcagtccagcgtgtcgatccgcggcctgggcaacaacccggccagcgatggcctggaaggcagcgtggggctgtatatcgacaacgtctacctcggacgcccgggcatggcggtgttcgacctgatggacatcgagcagcttgaagtcctgcgcggcccccagggcaccttgttcggcaagaacaccaccgccggggtgatcaatatcagcacccgcgcaccgagctttacccccgaacgcagcattgaaacttccttgggcgaggacggttatttccagaccaagggcacgatttcaggcccactcagcgatgacctggcggggcgtttctcggcctatcgcacgcgcagcgacggcgatatcaaaaacgaacacgacggccatgacctgaacggtggctctcgccagggctttcgcgggcaattgctgtacaagcccaacgaggcgttcaacctgcgctggatcggtgactacaacgaagaggactcgagcgccggcacccgcgtgctgtacagcaccgggccgaccatcaacggcaccaacctgtatcaatcgcgcgccaacgcggcgggggcgaccctggtggatggcacccatcgcaaggtcaacctggacaacgaccagcacgtcaccgtgttccaaggcggtacctcgctggaagccaactggacgctgccgagtgacttcaccctgacctcggtgagtgcctaccgttggtggaatttcaccccgcgaaatgatgacggcctcaacgtaccggcgtcgtacaacgccggggtgtcggtggaagataaacaatggtcccaggaatttcgcctggcatcgcctacggggggcttctttgattacgtgctcggcgcctactacttcggttccgacctggataacaagtccttcgcctattacgggcccaaggccgacatctggaatggcacgccaactggcgcgttgaacaatgtcagcagcatcggcaacgggcatatccgcaccgacagttttgcgctgttcgcccaaggtacctggcacctgaccgagcagctggatttcaccgccggcctgcgcggcacctatgaggaaaaaagcgcctgggtcacgcgcaatgccccggtgggcggcgccgccgtgaccggcggtgctgccacggcgcggcgtgggcgtaccggggcatatgactccggcgacctgactcagtacagcaccaccccgtcggggctgctgaacctcagttatcacttcaatgaaagcttgctgggctacgcaacgctgtcccacggcgagaagtccggcggggttaacctggcggtgggatctgcgccgacggccggggccgactcgctgctgatcggcaccgagcgcgccaacaatgccgagctgggtttcaagagcaccttgtgggaccgccgcctgcagctcaatgccaacctgttctggacccaggtcaacggctaccagaccaacgcctacgaccaggacaaccgcgtgcagtacctgaccaacgccggctctgtacgctcgcggggcgtggaagtggaaagcacactggtgccgatcaagggcctgaccctgaatatcaacggctcgttcaatgacgtgagttacctgtcatacaaggatgcgccatgcccgccggaagtcagcctgcgcccgggtgcgccggcgtcctgcgacttgagcggccatcaggtggtgggtgcgtcaaagtggatcgccaatgccaacggcgagtacaagtggaacctggccaacggcttcgaaccctacgtcaccgccagctatgcgttccgctccaaagccgtgggtacggtggaagattccgattacgggcagatcccggcctatgcagtggtcaacttatctaccggcctgcgtggcaactatgaccaagggcagtgggatgtgtcgctgtggctgaaaaacgccttcgacaagacctactacaccacactgtggaccggcggtaacggcggctatgaaggtttgctgggcacgccgcgcaccctaggcgtgactgggcgctacgacttctaggtcggtgcgataggtggccgggctgaacacccgtgtcaccagcagcatcgccaccaccgtcgcggtcaacaccacccaggcgctgataaacgtgccggtgagttcgcgcagccaaccggtcagccatggcgaaatcgcattgatcaaaaagcccacgccttgcacgaacgccgccagttgcccggcttggcgagggtcgcgatggtggtccagggtcagcagcaggctcagggcaaaacacgcacccaggccaaagccgatcagcgccacccacaaatgcgggaattgctgcggcgccatcagcaggccgaggtagccgacagtttgcgccagcaggctgatgcccagcagtgggcgccggtcgatgccgcgttgcgccagcaccggcatcagcagtgcggcgatcacctggaagatggtcatgaaggccagcaacgaaccgcttggcagcacaccccagcccagttgctgatagtaggcgggcagccacgccaccatgctcatgtagccgcagttcaccaggccgaaatacagcgccagcagccaggcgcgacggttgcgcaagccctcgaacgcgggggcctgctgcagatttctggcggcgcccagcggcaaccaggcccacaacagcaacgcccccagcgccggcaataaccacacccccaagcctgcctgccattgctggaaatgcgtggccaccaccgggctgagcagcgccgccagcccaccgccggccatcagcgaggccgaatacacgcccatcgccaccggcacgcggtgatggaattcgcgcttgatcatcgccggcaccaacgcctggatcagtgccacccccgcgccgccgagcaaggcggtgaccagcagcgccgacgcctggcccatcagccagcgcgccaggcacgccagcagaatcatcatcaagcccagggcgatgccgcgacgttcgcccaagcgggcttccacgcgcacgcccaccaatgccaccaggcccatgcatatcaccggcaggctggtgagcaaggcgctgctctggaagctcaaaccggtggcctgacgaatctcgccaagcaaagggctgatggaactgaggatggggcgcaggttcaagccgagcaccaccagcaggccccagccagcgagggatttattcagggtcatgcagggttttccactggtgatacagcgcggtcatgctggcgtcgggcaggtgctggatgggcaggcgctgcgcctcaatgggcaggccgacctgttggctgatcgccgcagtggacaggccgaacggttcggccatggcgttgctggcggcaaacaccacgcgctccacgccacacaggtacatggcgctcaggcacatcgggcaaggctggccgctggcgtagatcacgcagcggtccaggcgtgcgccgagttgccggctggcggtgcggatcgccagcagctcggcgtgggcggtggggtcctgggtcaggtggatctcattcacggcttctaccagcaccttaccgtggcgcgtgagcaccgcgccgaagggccggccgccttgggcaacgttggcgcgggccagggcgatcgcgcgttgcaggtgtgattgatcgttggtcatgcaagcccccaggtgcgatgaaaggtgaagtatggtcagccaccggggtatgctgaaattaaatataaacatgccaatcagtggcaaaagtaatggtggcgcctttgttcgatcccgtgttgttgcgcagctttgtcgccgtggtggactgcggcaatttcacccgcgccgccgagcgcctgcatttgacccagtccaccgtcagccagcagatccgccgcctggaagacgcggtggcgtgccagttgctggaccgcgaccagcgccacgtggtggccaccgccgagggcgaacgcttgctagcgtatgcgcgccgtatcctggcactgcacgaagaagctgccgacgtgttgatcaaccagcagagcgacggtgtgctgcgcctcggtgtgccggaggatttcgccgccgagcgcctgatgccgctgctctcggcgtttgtcgtggcctatccacgggtgcgattggaggtcaccagtggcctcggcccggaattgcagcgccagtaccggggtggggagttcgatgtgttgttagtcaagcagatgggcgacagcgacgactgtgtggcgtcgtggccggaacccttgtattgggtcgacagcctgagcaccccggcgctgggccgcgacccactgccgctggtggcctttccagtgggcggcctgtaccgcaatgacatgctccatcatctcgaacgctgcggttggcgctggcgtatcggctactccagcgccagtctggccagcgtgtgttcggcggtggcggcaggcctgggcatcagcctgttgccggagcgggtgctgcaaccgggccatcgcatcctcggcgccgagagtggcttgcccgcggttcacggtgtgcgattggcgttgtatggccgcaatggcttaggcgcggcggggcagacgctgttggacgaattgctggcaatgtgtggagggaacccgcactgagccatacctttgttgaatattttgtatgcctggaaagcattgaaaaacagcggcttggcgctaggccacgcacgacgtggctttgaggttgtcagcgattttctttatgtgtttttgatctatctataactttaaagattactttaagagataagtgtcaggccccgatgattcagccctcgacggccgctcctgcaggcccgtcggttttttaaagccgtagggagtgaatcaatgggcaatgtccagaccgccgccagtgcacatgaggcgccatggcgccaggcaccgagtggtgagttggtcgaccttggccgaccgcaccgcgcgccattggggcaattgcgcttacaaaagacgccgaagcgtttctcgagccgtcgtgaagggctcctgctcgggttactggtattggcgttgcacggcgcagtgatttattgggtgagccagaaacccaccccggtgctgccgattgtgccgccggaaataccgccgatgaccatcgagttttcccagccggcgccgccggtggttgagccgccaccgcccgtaccgccacccccgccaccgcccgtggtcgagccaccgccgccggttgtggatgaattggcggccaagccggcgccgcccaaaccggttcccaaagccaagcccaagccggtgcctaaaccagagcccaagccggtacccaaggccgtcgaacagccacctgcaccgccaacgccagcgccacctgctgcgcccataccagcggcaccagccccggtaacgcccgcgtcggccaacgccgcgtacctgaagaacccggcgccggagtacccgtcactggctcagcgtcgcggctgggaaggcacggtgttgttgcgggtgcatgtgttggccagtggcaagccgggtgagatccaggtgcagaaaagcagtggtcgccagcaactggatgatgccgcattggcggccgtgaagcgctggagtttcgtgccggccaagcagggcgatgtggcccaggacggctgggtcagcgtaccgatcgatttcaagattcattaattattcggctgcggtgtgcttacgccgcgacctgcacagagggaaaacatcatggcattagcatctccacttgaatccatcgaaagcgcggtgatctggctgctggtggccttttcagttgccacctggggtttggccttattgaagggtgtgcagttcggtcgtctgaaggcccaggatcgcaagttccacaaacagttctgggcggcgtcgagcctcgactcggccgctgaactggccgagacccaacccggtgcggccgctcgcgtagcccaggccggttatgcggcgattcaggtgggtgattccacccacgctgcggatttgagccaggcgatcaaccatcaggaccgccttgaacgcgcgctgcgccagcagattgtgcgtgagcgtcgctccctggaaaccggcctggcggtagtcgccagtatcggcagtacctcgccgtttatcggcctgttcggcaccgtatgggggatcatggaagccctgaagggcatcagcgctgccgggtccgccagcctggaaaccgtggcggggccgattggcgcggcgctggtggcgaccggcgtggggatcgctgtggccgtgcctgcggtgctggtctacaactatttcctgcgccgcctgaagctgacggccgcagacctggatgactttgcccacgacttctacagcctggcgcagaagcattcgttccgcgtgctgctgcatccggcattgaccaaagccagcgccgccagcccgcagaaagtcaaggaggcgtcctgagatggccttctccacgcaagacagtgatgaggtgctgagcgagatcaacgtcacgccgctggtggacgtgatgctggtgttgctggtggtgtttatcgtcaccgcgccactgttgaccaattcgatcccgatcaacctgcccaagacccaggccgtggcgccggtcgagcagaaagacccgctggtggtgagcatcgacggcggtggcaaactgtttatcaacaaggatgaaatccagccggacctgctggaattcaacctgcaggcggccaaggccaaggaccccgatgtgcgggtgcaactgcaggctgacgatggggtgaactatggcgaagtggcgcgagccatggcttcgattgagcgcgcagggattaccaagttgtcggtgattaccgctcgttagtttaacaagccgcgataagttttttgggccgtttccttggcagggtgcggccttttttttcaactgatttatttgacctgatgtgtcgtgtcttattgttgtttcggtaaaaactgtacatgttttttagtttttcagagagtgcaattttccgtgatgtaattatgctctgcagtacagggagttattacatttatggagaaaagtatgactattggttttcctgctcatcacgtgaacacgcgttttgattcgagcgcgcaagtatcacaatcgcaaccaatacaaactgttacttcacccatggcgtcaggtgcggcacatcctttggccaacgcctggacccgccgttctggttctataaaacgtgaaatctctgcgcaaatagcgcaatcggccggtctctcccgtggggcggacgctggccgttcaacgccgaggcagaatgttgaaatagagacgtacataaaaaaacatgcagacgactttgtttcacccgagaaagaaatttcaactattctcgcggctaaaatcaaacagagttggggggtagaggtcgatccggacaaaacctaccttgtgaccttcaagagcgacagtgaagatgaaaaagatgttgtagaaaaaataaccctgacacaggcagcattaaagaataggcaagatacaccgattgaagatgacaaaggctggtttcgaaagtttgcccagtacttttcgcccttggtatatggctacaacaaagtagacgaactcatacggtctgcgagcagccgacaagccatctatcgcgaaccgcagcctcccgaaactgcgctttatactgcggctacgaaggtttcgatccctgtcagtggcttcaaggcgctggtatgggataccgaaaggacccagctctacaaaggcacgcttgatgggttctgggaaaagcacacgggttcttatgcatccttgagcaaaatcgccttcgtcaaggcgatcaatctacagcgtctggagggtacgctcgatcctgtcgaggcagatctggcccagcgagccttggggcctgtcgcgcggaaggcgtggtctgagctgacgctcggggattttgcccatcctgcggtcaaggatccgaatctggacatgggtttgctgagcatcaacggtttgcagtccacggacctgatgtttgtgacagatcggcacacgcagctgacgttgctgtacatcccgggtaattcgtcgccgatacaccgtttcgataatcccgggcaaatgcgaacctggctcgccatgcaggcgtctgacccggtaaaacgcgagtcgctgttgacgcacttttccctgaaggatcaggcccgcaaagcgttttcggatggtgtacggcaaaccctggagggcttgggcaactggtccgatgcccaggcgtcgggaaatgccttcctgtctgagcttaatggttgggtgccggaacgctttattgcgctcgacccgttgagtggcgatcctttccaacaagtcatggtccggcagaaagcgcgttcttactcggatgccgataacgcaatcgtcagcgacagtgactacacgaagaacaaaatagcccagggcgtggaagaagccgtaaaagcggcaatgttcatgacgcccctggcgctggtgatgccggaagtcgcgattgcattggatgcattctacctggctgccggtgcgacccaagtgggtattggcatcgatgacgttgccaagggcaaggcttcgggcactgaccgtattgtctttggtgtcttgaacgcagtgccgccactggccggccatgcaggggcaccgcttgccaaggcgctggcaacggcaaaggccgggcgcaacgaagccagccaatttgtggcggcgggcattgatgccggacgccaggcgcccactcggttagctgaccagcggcctgcgttcctgaatcctcctcagcgtatcaatggccagatcgggtatccgatgagcccgctgtcgccgccctcgctgcttgatgagttcaccatgcccatggacgacgtttttaagatgggctcctcggaacattatcgtgtattcgtaaatggctactcaaatgaggtcaggtatgacgtagccgcaggcctgtggcgcggcgtcaatcatgacggcacggtcaatgacattttctattggcgcgagggtgaaggccgatgggcctctggtactagaagcgaagcgcttgcaggcagacaaaacgcgcccgccgccaccgaaaacaagaccgtcaggttcccaagcttgccgccgttaccatcgaacgttgcgccgctaccgaaagtgattcactacttttgggctggaaatggaatgccggagcatttaatccaaaatattctcgaaaactcgagaaagagtcctgggtataaatccatcgttcatgtagatgctaataatgcacgggtgcttgagagcatcacgtctgctctggatcataaggtgggcgggctggaagtccacgacttgaaacaagatgaagcttttcaggcgtttaatgcgagccagtatgcagaaatgtatcagtattttcgctcaggccaagggcagaaccttgcagcgtcatcggatgtgatgcgcgtcgtcttgataaaaaagcacggtggcatctacctggatacggatgattcgctcactgtcaatgtgggtaatgtcgaactcaatgcctcacccactgatattttgatgaatgcgcctgttaattacgagcctgcggattttcaaggcttcaataccagtaacttttccagccatgcggataacccattgcttgaggaaatcctggagcagtcttataagcgcttcaaggaaaataaaccttggttggatacgcatcgtccaatgcttgacgctcattcaaccactgccgagcggcaagcttataaaaactacgaaaagaaaattttcgagattaccgggcctaaactctttgctgatgtgctgggtgaagcagggtacggctttttccctactgtgaatgacttggtagaagcggtaaatacgaacgtggtgctgccgagaaactatgcagcacgcttgagtgaatcgcaggggcattacatggcgatgcgtcacaagcttgacgtcgagatcgggggagagcactccatggctcattcgcgctgatgccgaggagcctctgcaggcaaaaagtggcagtcattaatcatccgcttatgcgcccccgtcatcttcagtcggggccgcgttgggcaattcttgatgcacgcctggcgcaaaacgaaggatggctgcaaagtcattttggttattaataaattcttttttattccttattatgtggctgggtcgaccctatactgcttagcaacgttaaacgctgcaggagggcacacccatgcacagcgagtcgattcgttacctgatcgtgccgggctggcaaggatcgccagaagatcattggcaaacccattggcagcacagcctgcccaatagcgcccgcgtggagcaggctgactggctgaccccgcgccgcgaggactgggtagccgcactggccgaggcgattgccgctgacagcacgccggtgatcctgatcgcccatagcctgggttgcatcaccgtcgcgcactgggccgctactgcaccggtgcattgcttgcgtcaggtacgcggcgcgttgctggtggcgccggcggatgtcgaacgcccggcctgcgcgcccgccctgcgtaactttgcgccaattcctaccgacctgctgccgttcgccagtcaggtggtcagctccgacaacgacagcgccgtcagcgccccgcgggccctggagctggcgcgtcagtggggcgccgaagccggcattttgtccggtgccgggcatatcaatgtgaagtccggccaccgtcgttgggagcagggtttcgcttatctctatcgcctgcaaaaccgcctcgagcatcatgctcggcgcagtgcctgatattttttcaacgccccgtccctgagtggattgggggcgggagcctgccatgagtcaagaaatcttcggccagccgctgctgacctttcccgacgccgaaaaaagcccgctgagcatccgcgccaaggcgctggtatttgtcgacccccgctcacgccaactgcgtgaagagctggaaaacctagccccgcgtgccttgccagtgttgattcgcggtgaaaccggtagcggtaaggagctgctggcgcgacacatccaccgtggcagtgatcgcaccggcttgtttgtctcggtcaattgcggcgcgatcagcccgacttacgccgacgccgaattgttcggctacaccgccggtagctacagtggtgccgccagcagccgcgccggctggttcggctcggccaatggcggcaccttatacctggatgagattggtgacttgccgctgccgattcaggtcaagctgctcgcggccttggaaaaccacgaagtcacccgcgtcggcgcccatcagccaagcccggtggatgtacgcctggtggctgccaccagcattgacctggcccaggcggtggcggtgggtaaatttcatgagcgcctgtttcattacttgagcgaaggccagttggagctgccagcgttgcgtgagcgggtgggggatatattgtccctggccgaatatttcctcggtatctatagccagcgcctggatctgccggtgccactgatcagcgacgccgcccaacgtgtgctggaacaccacgcgtggccgggcaatacccgtgaactggaaaacgtcattcactttgccttgctggtgagcagcggtgaagaaatcctgcccgagcatttgaacttgccggtgacgggttcaccgctggagcaggtgcggcggatctatgccagtgccagcccagccgagcaggcatcactgcgtaaattcctacatgaacaaaatggaatatcaacgtgaataaaagatattgttcgggaataaaaaatctaggtattgtccctcccacgccgcgatagcacttcgctggcacctcacataaaaacggtcgttataaaaggacactgcatgaaaaaggttctgttgtttaccgcactggcggctgccctgactgccggcttcgcgcaggccaacgagaaattggtggtggccgccacgccgatcccccatgcggagatcctcgagctgatcaagccgaccctggccaaagaaggcgtggacctggaaatcaaagtctttaccgactacgtacaacccaatacgcaggttgccgaaaaacgcctggatgccaactacttccagaccctgccgtacctggaaaacttcaacaagggcaaaggcaccaacctggtcaccgtagtcggtgtgcacgttgaacccatcggtggttactcgaagaagatcaagaaaattgaagatctcaaagacggcgctaccgttgccatcccgaacgaaggctccaacagtggtcgtgccctgctgctgctgcaaaagaacggcctgattacgctcaaagacccgaccaacgccttgtccacgccaaaagacatcaaggaaaaccccaagcacctgaaattcaaggagctggaatcggccttgctccctcgggtgctcgaccaggttgacctggatgtgatcaacaccaactacgccctggaagcgggcctgaacccggccaaggacgcgttgatcatcgaagacgccaagtcgccctacgtaaacttcctggtcgctcgcccggacaacaaggacagcgacgcgatccagaaactatccaaggccctgaccagcccggaagtcaaagccttcatcgagaagaagtacaacggcgcggtagtgccggcgttctgatgtaactcaaaacccccttcaaggtttgaacgccgacggctactacagcgtcggcgtttttttatgcctgaaccttggaatgcgattaaaggcgggagggggctcccgataacagtggttcagtcagtacatctgtgactgaccgctatcgggagcaagcccctcccacatttgatctccatctcatatttgatcttcagtgtgtcagagcgtgcggctctcaatcgcccggcgcaacgccaccaaccatttcaccagctcctgcggatcaatcggttttgcttcgttcatcgttcattccctcgaaacacagacccctgcaaccatagttcgcacccgaactccggggttatctttttgggtgatatcaatatgctatttaggtatttaaattttactttttatagctttaaagttcgcgctacccgacgttatccctgtcggaacggactgcgctcgccgcattaccccgcggcgtcatggactcacaatgaccttcgatttcgcttttatcctcagcaccctgcctgccttcctgcaagccgtgggcgtgacgctgcaagtgggcctgatcgccattggcacctcgttgctggtagcgctgatcaacgcggcgctgctggtgtttcgcacgccatacctgtcgcgcctggtggcgttgtatgtggagctggcgcgtaatacgccgctgctgatccagctgttcttcgtgtacttcgcgctgccggccctgggcgtgaatatctccgggttctgggcggcgatcatcaccatgacctttcttggcggtgcctacctcaccgaagtgctgcgcgccggggtggaagcggtgccgctggcgcagatcgagtcgggcaagtccattggcctgtccgattggcagctgctgcgccacgtgatcctgccccaggccggcattctcagcttgccggcgttgttcgccaacttcatcttcctgctcaaggagaccactgtagtttccgccgtggcggtgccggaaattctctacaccaccaagagctatatcgccctttactacaagacctacgaaatgctcgccgtgctgacgttgatctgcgtgctgctgtttttgccgctgtcgctgctgctcagccgcctggaaaggaggctccagcatggccagttcgggtcttgagttgttgtgggtgtcgttgccgcaactgggcaagggcgcggcacaaaccctgtcgatttcgttgctgagcatcgcgttcagtacgctgggcggcgtgttgtacggcgtgctgcgcaccttgggtaaccgcttggtcaacctggtgctgcgggtttacctggagctgttccgtgcgattccggtattggtgtggttgtacctgctgtttttcggcctgccgattttctttggcctgagcatccccagcttctggtgtgcggttctggtgctgtcgttgtggggcgccagcgaggtgggtgaagtggtacgcggcgcgttgtattcgctgccccgcggccagcgcgaagcgggcttgtcgattggcctgtccgacccgcagttgtacggctatgtgctgctgccccaggcactcaagcgcatgaccccgccgactatcaacgtctacacgcgcatcatcaagaccagctccctggcggtgctgatcggcgtggtggatgtgatcaaggtcggccagcaaatcatcgagcgcacctacgaatcggtactgatctacggcgtgctgttcctgtttttcttctttatctgctacccgttgtcggccgcctccaaggtgctggaacggcgttgggcccaagcatgagcgcattgatcgagttccagggtttcaataaattcttcggtgaccaacaggtgctcaagggcatcgacctgagtgtgcaaagcggcgaagtggtggtgatcctcggccccagcggctgtggcaaaagcaccttgctgcgttgcctcaacgggctggaagtcgcacacagcggcagcctgcgtttcgccggcaacgagcttttgcacaaaagcaccgactggcgccaggtccgccaggacatcggcatggtattccagagctaccacctgttcccgcacatgagcgtgctcgacaacatcctgctcggcccgctgaaggtgcaaaagcgcgacccccgcgaggcccgtgcgcaggctgaaaaacttctcgagcgcgtaggcctggccgacaagcgcgacgccttcccgcgccagctctccggcggccagcagcaacgcatcgccattgtccgctcgttgtgcatgaacccccaggtcatgctgtttgacgaagtcaccgcggcccttgacccggagatggtcaaggaggtgctggaggtgatccagggcctggcccgcgatggcatgaccctgctgatcgtcacccatgaaatggccttcgcccgcgccgtcgccgaccgcgtggtgttcatggaggccggccgcatcctcgaacacaacacccccgaggcattctttacgaacccgcagaccgcacgcgcgcagcagttcctggagaagttctcctttgtttcaacactgcccaagaagatcaaggaactggagctgatatgaaaaagttactgctgccgctgtttgccgtcgccttactggccggctgcgataaaaaggccgaagagcctgccaaacctgttgctgctgcgagctatatcgacaagatcaaggcgcgggacaagctgatcgtcggcgtgtttaccgacaagccaccgtttggctttgtcgatgaagccgggcgctatgtcggcttcgataccgacatcggccgccaattcgccaaggacctgctgggcgacgaaaacaaggttgaattcgtggccgtggaaccggccagccgcattccgttcctgcaaagcgacaaggtcgacctgatcctcgccaacatgaccgttacgcctgaacgcaaggaagcagtggacttcaccaaccccaacctgaaagtcgcggtacaggccctggtgcccaatgacagtacggtcaaaaacctggctgacctggcgacccgtacgaccatcgtcaccaccggtaccacggctgatatctggctgaccaagaaccacccggactggaagctgctcaagttcgagaaaaactccgagtcgttgcaagcgttgtcggcggggcgtggtgatgcctatgcgcaagacaacctggtgctgttcagctgggccaagcagaacccgggttaccgcgtgctggaagaaaaactcggtgatgaagcgccgattgccccggcggtgaagaagggcaatatcgaactgcgcgactgggtgaatgccgagttggcgaagttgggtgaggagaagttcctgctcaagctgtatgaccaatacgtgcgcaaagagctgagcgatgacaccaagcctgaaagtgtgattgttgaaggcgggaagtggcagggctgatctctggactttgtgttggctgtccgggcctcatcgggggcaagtcgaatcgatgaggccagcacagccaccgcctactccggccaatgccaagccggcccatccaacatcccctgtccgacgatccgcgtctcccccatcaccttctccagcacaatcgaattacacccctcatcctgctgcaacgccgcaatcaagcggctggcatgggacaccacccacacctggcaatgcatcgacgcctgggcaatcaggcgcgccaacgccggcagcagatccggatgcaggctggtctcgggttcgttcagcaccatcatggtcggtggccgtggcgtcagtagcgcggcgatcagcagcagatagcgcaaggtgccgtccgacaactccgccgctgacaagggacgcagcaggccttcctgataaaactcgattgcaaaccgcccgccctgcaaaggttggatattcaggcgtgcccccgggaatgcatcgctgacggcgtgctgcaatgcctcggcgtcgcccacttcgcgaatggtctgcaacgctgcggccaggtcccggccgtcgtgatgtaacaccggtgtgcgggtgcccaattggggttggcgcaccggcgcatccacatcactgcgaaagtgatcataaaaacgccagccacggatactctcgcgtagcagcaacacttccggcgagccacgcaggttgcccacctggtcgaacaggctgtgatagttgggtgtgtgctgggccaatacatcccaggcgcggccgtcacgcgcccgtaccatcggcccggatcgctgaaccagtaggctggccgggcggtagagggggccggcccagatacattcctttttgatttccgggtccagtttgaattcgctgccggggaccgggatgggcaggcccagggagatggcgtagctgaaatcctccccggcaaaccccaggcgcaggcgtttgaccccttgggccgcggtggcctccaccggcacttcgccgctgcgcatacgccgagtgatggtttccgggccggcccagaaggtcgagtccagcccaccttcacgggccacggcattgatcaccccgccctgtgcggtttcggccagcaagcgaagggcccgatacaggttggacttgccgctgccattgggcccggtcaccagattcagccggtccaggggcaccaccaatttattgatcgagcggtaattggccaccgcgagggttttcagcatgtgtatttagccggcatgggaaccattggagtatgggatcctccatgcagataaggaaccctgatctaagctcacagtcgcatacacacttgtaccttgcgtcgcgcaaaaggagcctgcatgggcggtcgtacttcgacatttattttcagccttggcctcctggcgctgctgagcggctgtggccaagacaaagccgagcccaagcagcattcccgggtgtttgtacaaactgtacagtcggcggatttcgccgcagcggtgacactcaccggggatatccaggcgcgggtgcagaccgacctgtcctttcgcgtgggcggcaagatcatccagcgcatggtggatgtgggcgaccgggtgagtgccaagcaagtgctggccaagctcgaccccaaggacctgcagaccaatgtcgattccgcccaggcccaggtcgtggccgaacaggcgcgggtcaagcagaccgccgccgcctttgtgcgccaggaaaaactcttgcccaagggctacaccagtcgcagcgaatacgacgccgcccaggctgcgttgcgcagcagccaaagcgccctggccgctgcccaggcgcaactggccaatgcccgcgaacagttgggctacaccgcgttggtcgccgatgcgccgggggttattacagcgcgccaggccgaagtcggccaggtggtacaagccacggtgccgatcttcagtctggcccgggatggtgagcgtgatgcagtgttcaacgtctatgagtcgctgctggtggagccgccgtcggatgcgccgatcaccgtcagcctgctggataacccaagcatcaaggctgtgggcaaggtccgtgaagtgacacctgccgtggccgccaatactggcaccctccaagtgaagattgccctgcaaagtctgcccaagggtatggagctggggtcggtggtgagtgccacggccaacggcccggccaaggccagcatcgagctgccttgggccgcgttgaccaaagacctcagcgaacccgccgtgtggctgatcgacggcgacggcaaggcgcaactgcacaaggtcacggtggcgcgctacctcaccggcaaagtgatcattggcgacggtctcaagggcggggaaaaagtcgtggtggccggtggtcaattgctgcaccccggcatgcaggtcgagatcgcccagcaaggagcccagccatgaagcaactgacggttatcgtcgccacgagcctgttgctgatggcctgctccaaggaagaagcaccgcccgaaccaatacgcccggtgctgtccatggaagtgaaggcagaggaccaggaacacctcggccgcttcgccggcaccatccaggcccgctacgaaagcaacctgggctttcgcgtgtccggtcgcatcgcgcgccgcgccgtggatgtgggcgccgaagtcgagaagggcgccttgcttgccgtgctcgaccccaccgaccagcagaaccaattgcgcgccgcccagggcgacctggcccgcgtgcaggcgcagttcatcaatgcccaggccaatgcgcgccgtcagcaggagctgttcaatcggggcgtgggcgcccaggcccagctggacgtagcccagaccgacctgaaaaccacccaggcgaccctcgaccaggcccgtgcttcggtcaaccaggccaaggatcaactcaactacgccgagctgcgtaccgaccacgccggcatcgtcaccgcctggaatgccgaggccggccaggtggtcagtgccggccagcaagtggtgaccctggcgcgcccggacatcaaggaagcggtgatcgaccttcccgccggcctggccgagcgcctgccggcagatgtggtgttcctggtcgccgggcaactggaccccagcgtgcataccaccgccgtcgtgcgcgagatcgaaccccaggcccagagcgccacgcgcactcgccgcgcacgcctgagcctggccgaaacaccgcccgcgttccgcctcggcaccgcgatcagcgtgaccttgagcaccgccattgccccgcgcatcgaactgcccctgagcgccctgcaggaagacgacggcaagacccgcatctggatgcttgatacccagagccagactgtgcagccccgtgaggtcagcgtccttagccgtagcggcaacagtgtcttgctcaacggcagcgtcaaacccggcgagcgcattgtcaccgccggcgtgaacagcctgaaacccgggcaaaaagtcaaaatcgacgagggcagttcgcgatgaaagggagtttcaacttatccgactgggccctcaagcatcagtccttcgtgtggtatctgatgttcgtcgcgctgctgatgggcgtgttttcatacatgaacctgggccgcgaggaagacccctcgttcaccatcaagaccatggtcatccagacccgctggccgggcgcgacccaggaagaaaccctcaagcaggtcactgaccgcatcgagaaaaaactcgaagagctggactccctcgactatgtgaaaagctacacccggcccggcgaatcgacggtgttcgtgttcctcaaggacaccaccagcgccaatgccatccccgacatctggtaccaggtgcgcaagaagatcgatgacatccgcggcaccttcccccaaggcttgcagggaccgtcgttcaacgacgagtttggtgatgtattcggttcggtgtatgcctttaccggtgacggcctgtcgatgcgccagttgcgcgactacgtggagcaggtgcgcgccgagatccgctcagtgccggggctgggcaaggtcgagatgatcggccagcaggacgaagtgatctacctgaatttctccacgcgcaaacttgccgcattggggatcgaccagcgccaggtcgtgcaaagcctgcaatcgcagaacgccgtaaccccggccggggtgatcgaggccgggccggagcgcatatcggtgcgcacctcagggcagttcgcctcggagaaggacctggctgacgtcaacctgcgcctcaatgaccgtttctatcggctggcggatatcgccgacatcagccgtggctatgtcgacccggcgcggccaatgttccgcttcaacggcaagccggccatcggcttggccattgcgatgcagaagggcggcaatatccagtcgttcggcaaggccctgcaccagcgcatggacgagctgaccgctgacttgccggtgggcgttggtgtgcacaaggtgtccgaccaggccgaggtggtggaagaggccgtcggtggctttaccagcgcgctgttcgaggcggtgatcatcgtgctggtggtgagttttatcagcctgggtatgcgcgccggcctggtagtggcgtgctcgattccgctggtgctggcgctggtattcgtattcatggaatacagcggcatcaccatgcagcgagtgtcgctcggtgcgttgatcatcgccctcggcctgttggtggacgatgcgatgatcaccgtcgagatgatgatcacgcgcctggaaaaaggcgaaaccaaggagcaggcggcgacctacgcctatacctccaccgcgttcccgatgctcaccggtaccctggtgaccgtggccggttttgtaccgattggcctcaacgccagttcggcgggcgagtacacctttaccctgttcgcggtgatcgccgtggcgatgctggtgtcgtgggtggtggcggtgctgtttgcaccggtgatcggtgtgcacatcctcagcgccaatgtgaagccgcacaatgctgagcccggacgcatcggtcgtgcgttcaatggcggcatgctgtgggccatgcgcaaccgttggtgggccatcggtatcactgtgggcctgtttgcggcctcggtgttttccatgcagtttgtgcagaaccagttcttcccgtcatcggatcgcccggaaatcctggttgatttgaacctgccgcaaaacgcctcgatcaacgagacacgcaaggccgtcgatcgccttgaagcgattatcaaggacgatccggacatagcccgctggagcacttatatcggtcagggcgcgatccgtttctacctgccgctggaccagcagttggaaaacccctactacgcgcagttggtgattgtcagcaagggcctggaggagcgtggtgcgttgatcgcccgcttgcaacagcgcctgcgcgatgattttgtcggcatcggcagctatgtgcagccgctggaaatgggcccgccggtggggcggccgatccagtaccgcgtgtccggcaaagacatcgatcaggtgcgcaagcatgctatcgagctggcgaccttgctcgaccagaacacccacctgggcgagatcatctacgactggaacgagccgggcaaagtcctgcgggtcgacattgcccaggacaaggcgcggcaactggggctgtcgtcggaagacgtggcgcagttgatgaacagcgtggtcagcggtgcgtcggtgacccaggtgcacgacgatatctacctgatcaatgtggtcggccgcgccgaagatgccgagcgtggcaccccggaaaccttgcagaacctgcagatcgttacgcccaacggcacttcgattccgctgctggcgttcgccaccgtgcgttacgagctggagcaaccgctggtgtggcgacgcgaccgtaagccgaccatcaccgtcaaggctgcggtgcgcgatgaaatgcagccgacggacctggtcaagcaactggcgccgaccatcgagaaattcggcgctgacttgccggtaggctacaaagttgccaccggcggcaccgtggaagaaagcggcaaggcccaggggcctatcgccaaggtagtgccgttgatgctgttcctgatggccaccttcctgatgatccagttgcacagcgtgcagaagatgttcctggtggcgagcgtcgcgcccctggggctgatcggcgtggtgctggcgttgatccccacgggcacgcccatgggctttgtggcgatcctgggtatcctggcgctgatcggcatcatcattcgtaactcggtgatcctggtgacgcaaatccacgaatatgaggtggccggttacacgccgtgggatgccgtggtggaagccactgaacaccggcgccgaccgatcctgcttacggccgctgccgcgagcctgggcatgatccccatcgcccgcgaagtgttctgggggccgatggcctacgcgatgattggcgggattatcattgccaccttgctgacgctgctgtttttgccggcgctgtatgtggcctggtacaagatccgcgaaccgaagcaggagcaacaggaacaacacggttaaaaatgtgggagggagcaagccccctcccacattttgatcttcatagcgcttgaacaactgtgggaagcttccgaaaagtccgcttgccgccccgcccaatcgctacatgtcttaccctcttggcctttccctcccccaggtcgatccctatgtcttgcctgcgctccaccgtgctgctctgtgcgctcctgctgtcgccgccgacctttgccgctaccgtgctggaaaacgccctctggcgcatcgagttggacccggccaccctggccctgcgtgtgacgccatcgggccaggcctcggtgaacgtctccagcggcatcactgcccatagcgtcagccaagtgcagaacagctccgaccaggccagctggcaatgggacagcggcgcctatcgcctgaccgcacgccttgaacaacgcgacctggccttgaccatcaacgccagtcagcctggcgagttgccgctgctgcgccagcccgccgaagccatgggccaaggcttgctctggcccttggccgaagggcattacgtacccgccggcaatgccatatggcaggctttcctgcaggagcagggcgcgctcaataccacccaggacctgagcctgccgttatggggcatggatcatggaagctttaccctcaactggctgctgaccaacccctacaacaaccgcctccaatggcaggcggaaggcaaaggcctggcgctgtccctgacccatgagttcaccacgctggactccagcgcaccgatgacgctacgtctgcacctgggcgacgccgaccccttggccggagccaagcgctaccgccagtggctggtagagcagggcaaatatgagccgttggcggacaagctgcgccagacccccgaggcagaaaaactgctgggcgccagccatgcctacctgtggggcaatgacctgctggcgctggacgatgtgcgtgattggccgaagttggtcgagcggctacgcggtcatgcgcttgctgccctgtttgataaggaagcggccaaggtgctggcgcagaccacggcgttaagtcgttatgagcaggcggcgctgttgcgtggccttaacgccgcaatcaacaagcaggcgcgccaggcgtggcaagtcgaggagccggacatgacgcgactcgccgcccgctatggtgaactgcgccaggagctggcgacagcattcgccggagccttgggcggcagccctgaaagctggggcagcaagactatccaaggcctgcgcgatgccggcctgcctcgtctgctgctgaccctgggcgaaggctgggaaggcggcctctggcatcccgaagcgattcgcgccggtgtcgacgcgggatttctgatcgcgccctacgattcctacgaaaccgctttgtccgcggccgagaacccggactggactacggcccaccagggcgaccaggcttaccgcaactgcgcaatcatgctcaaggacggcaagctgaaaaccggcttccagcagtccggtcactacaccgacccccgttgcgtgcgaccgttgctggaggcgcgggtgcgggccgtgcaggccaaggccggcttcaacgcctggttcctcgacgcctatgccaccggcatgctgttcgacagctaccgggatggagcgtccatgacccaggcgcaaaacgccgcgggcaatatcgatgcgtcccgctggctcaacagcgtgctcaaggtgccggccggctccgaagacggcaacgccactactgcccagggcattctgtttgcccacggtatgcagacgccggtcatgggctggggggatcgggacatgacccaggacaagcagtcgccccattacgtcggcaactggttcccgccggagcaaccgacggtgtttttcaaacctgtgccattgaaagagccgtttcgcacggtgtatttcgagccgagcatgcgcctgccgttgtaccaggcggtgttccacggctcggtgatcaccactcatcactggctgttcgatagcctgaaattgagcaatgtgcaggttgagaatgagttgacccaactgctctataacgtgccgccgctgtatcacctgagtgcggcgacgcttaaggcgcgcttgccggtgattcaacgccaggaccggtttttccgaccactgcaccagcgtttggcgacccaggcgatgacggattttcgttggctgacagcggacaaacagctgcagcaaaccacgttcgccgatggcacgcggttggtggcgaacttttcggccatggaaaaagaagggtatgccgagcgcagtgtcacagcgctggtggaaggtgaaaaaccggtggtgtatcaggtagatcagcaacgccattgagaccatcgggagcaagccccctcccacatttaaatgtgggaggggggcttgctcccgatagcgtcagaccaggtaataaatcacttaagaccggcgccacacactcgccaaccaaggctgctgctcccgaggcaccccggccgggcggtagtaatgctccagctcttcaaacccggcctcaatcagcagcgcctgccacgcctccatatcgtgataagacccataccgcggcccattccagccttcctggttttcgccccgagggttggagctgaacagcacgcccccgggcttcaacgtgccatgcagctgcttgagaacccgcggcagttcctgcttgggaatatgaaacagcaccgcattggcaaacacgccatcgaagcgctcggcgggcaggtccagcttgagaaagtcctgctgcagcacctcgcagccgctgtcctcccgcgccatctgcgcgaaacgctcggagccatccagccccacggcgatatgccccatgcgggtgaaggtctgcaaatcccggcccggcccgcagccgaaatccaacacggtaaacggcgcggggctctgaatgtgccgcaataacgcgtcgatgttctggctcacatcgtgatcgcgggtgccttcacggaagtcttcggccaccttgttgtaatggccgagggtggtggtggtgatctggttgaggtcgtcgggggcaagtttcatggcatggcgcacggctgcggctgaggttggtgaactatacctcagcgcttgttcaacacccgcgccaatcgatcaccacccaactggatcaccgccaccaggaccaccagcagcacaatcaccgtcagcatgatctgcgtatcaaaacgctggtagccatagcgataggcaatgtcgcccagcccaccggcaccaatcgccccggccatggccgatgagttgatcatggtcaccagggtgatggtgaagccgccgacaattcccggcagcgcttcgggcaacaacacatgccagatgatgtgccagcgtcggcaacccatggcctgcgcggcttcgatcaggccgtggtcgacttcgcgcaggctgacttcggcgatgcgtgcaaagaacggcgtggcggcgatggtcagcggcaccacggccgcccatacgccataggtggtgccgacgatcagccgggtaaaggggatcagcgccaccatcaggatcaggaacggaatggagcggaacaagttcacgaacgcccccagcacgcggttaagggccggcgcctgatagatgccgcccttgtcgctggtgaccaggaacaccgccaggggaatccctaccagcaaggcgatcagcgatgacacaccgaccatcaacaaggtgtcgatggcgccctgcactaaacgatcaaaccacataacccagcacctccacctgctgtgcccaattgctggcgcggttgcgcagctcttcggcgttgtgcggcgagccattcaccgccagcagcaattgccccagggcatgcccctggatgcgttccacaccgccttgcagcaaacgcacgcgtccgccgagggcgctgaacaaggcggcgaggtccggctcatcgctatcgctgccggtgaactgcaagcgcagcaccagcgccgcgcccgccagggattgtgtgggttgcaggcggctttgcaattcaggcggcaagccgtgttgcagcggtgcgagcagggtcttgctgacctcatgcatggggttgccgaacacttgccacaccggcccttgctcgacgatacgcccgtgttccagcaccaccacgcggtcgcagatttcgcggatcacggccatctcatgggtgatcaacacgatggtcaggcccaggcgttgattgatttcgcgcagcaggccgaggatcgactgggtggtttccgggtcgagggccgaggtggcttcgtcgcacagcagaatctcggggtcgtgcaccagcgcgcgggcaatgccgacgcgctgtttctgcccaccagagagctgcgccgggtaggccttgtgcttgtcctgcaagcccaccagttccaacagctcacgcaccttttgctcgcgttggggtttgggtacgccggcaaccttgagcggcagctcgacgttctgccacacggtcttggccgacatcaggttgaagtgctggaagatcatgccgatgcgccggcgcagcgccaccaggtggtcttcgtcgaagccgccgatgtcgacttgatcaatcagcacccgcccactgctgggttgctccaggcgattgatggtgcggatcagcgatgacttaccggcgccgctgcggccgatgatgccgaacacttcgccatgctggatcgccaggtcgatgccttgcagggcgtgtaccgtgccgccgtaggtcttgcccaggttgataaagcgtacgtgggcgcggttgaggtccgggtgcagttcagtctgctcggcgtccctgggcgcatggcccaggtcgcgcagttgggcgttggcggcggtcattttttatcttcccaaccgacttggtagagcttgccgagggatttatccagcgccgcacgcaccactggcgagtgctggtagatgtcgacgaacttgattacccgagggtcggttttgctcttgggttggatgacgaactggatcacgtattccgggtggtccaggccgtcgaacagcagcgccgactctgcatcgaaggtcttggacaggcggatatacgccgggtaaccctgcaccaggtccgcatcgtcataggcgcgtaccagttgcaccgcttccacttgcaggatcttgatctttttcgggttggcgatgatgtcttcttcggtggctttgtagcctacgcccggcttgagggtgatcagcccggccttggccagcagttgcaggccgcgaccgctgttgatggggtcgttggcaatcgccacgctggcgccctcgggcagatcgctaatgcttttgtactttttcgagtacagcccgatgttattgatgatgcccggcgcatagggctccaaatcaaaaccggcggcggccttggcgttttccaggaaggggatgtgctggaaatagttcacgtcgatatcaccggcggcaaggctgacgttgggggcgatccagtcggtgaactccaccagctcgaccttcaggccttgtttgccggcctcttctacggccgcttccaggggaatggcgaaggcggcggtggtgccgattttcagtggtgggtcggcggcgaagaccgttgtgctgaataacccgaaggccagggccagtgctttgactgggtgggtgagcagtgtttttttcataatcaatttccagtcataaggtataggcacaaacaatggagatccaatgtgggaggggcggtgcgacgattcgacttgctcccgatagcggtgtgacagcaaacccatccggtgactgattcaccgctatcgggagcaagccccctcccacatttttgatcagtgtcggtagctggagccggtgtgttgttcgggtaagcgagcggtgccgtggaagactttttcccgcaacgtgccctgcgcatactcggtcttgtacgagccacgccgctgcagctccggtatcaccaagtcgatgaaatccacatagctctccggcgtgacaatgcgtgtcaggttgaaaccatccagcccggtttcgctgatccaggattccagctcatccgccacctgttcaggcgagcccaccaaggtgatatagcgcccacccagggcgtgctggtcgagcaatttgcgccgggtccagtcgttgttttgcaggggcttggtggctgactggattgcgttgctctttacgtactggatgggctcgtccagttcgtattgggagaaatcaatcgccgtcgaggccgagaaatgcgccacgccggcttccgcgctggcgtagctgaggtactcggcatgcttgcgccaggccaactcttcggtggcgcccacgatcacattgaggcccatgaacaccttaatatcgtccgggttgcgccccgcctccaccgcgctggcgcgcaccttatccacctgagttttggtcgaggccttgttctgcccgctgataaacacgcactcggcatgccgcccggcgaacagcaacccacgctcggaactgccggcctggaacagcaccggcgtacgctgcggcgacggctcgcagaggtgataaccctctacctgatagaactcgccgtggtgttcgactttgtgcaccttgcccggttgcgcatacacccgcgcctgtggatcgttgagcaccgcgtcgtcttcccagctgccttcccagagtttgtacagcacctgcaggtactcatcggcctggtcgtaacgccgatcatgctcgacctgttcagagaggcccatggccttggcagcgctgtcgaggtagccggtgacgatgttccagccgacccggccacggctcaggtggtccagcgtggacatgcgccgggcgaacagatagggcggctcgtaggtgaggttggcggtaaggccaaaacccaggttgtgggtgacggcggccatggccgagaccagcagcaacgggtcgttgaccggcagttggatcgactccttgagcggcacgtcaatcgagttctgatacacgtcgtagacaccgacgatgtcggcgataaacaaaccatcgaacaacccgcgttcgaggatctgcgccagctcggtccagtattcgagggtcttgtactgggttgagttgtcccgtgggtgagtccacaggccgtggttgatatgcccgatgcagttcatgttgaaggcattgagcaggatcttctttttgctcatcagatggtcccccgcagcggcgggttttcatcgttgaggtagtagttgcccacggcgtggtacttccagcgcaccgggtcgtgcagggtgtgcacccgggcgttgcgccaatggcggtccaagccatgttcggcgagcgtcgcctggctgccggccagttcgaacaaggtgctgccggcagccagggaaatctcggtgctcaaggcgcgcacttcggccacggcgatggacgcggcggcgacggtctgggcattgctgtcagcctgggcgcggtcgaggaattccccagagcgctccagcaaggcctcggcagcgtgcaaccgaatactcaagtggccgaagcttttgagggtcagcgggtcttcggtggctttgtcgttgccggaatcgatccagggacgggtcttggtgcgcacaaagtgcagcgcgtcttcaaaggcggcgcgggcaatgccggtgtcgatggccgcgtggaggatctgcgccagcgggccgacggtggtcgggcgttcgaaggcgctctggaacgggatcacgtcctgtgccgctacccatacgttatcgaataccaccgagccgctgccggtggtgcgctggccgaagccgctccagtcgtcgattaccgtcaggcccgcgctgtcgcggggcacgaaggccagctgctggatgccattttcatctaccaccgaggtggggatgcgttgcgcatagatagcgccagtggcgtagaacttgcgcccattgatgcgaaaaccatcgccgtcgcgggtgaggctggtcacgcggtcatgggcggtcttggtgcccaattccgccaaggcgttgccaaagcgctggccggccagcacctcggcgtacaggcgctgctgctgttcggggctgccgtttacgcgcagcacttcgagggcgtagaaatggttctgcgggatctggcccaaggagccatcggcctgggcaatcagcgcgatgaccttggccagggtcacgttggacacacccgcgccaccgtaggccttgggcacgctgatgccccacaggccggagcgggaaaacacgtccagttcgggcaatggcagacgccgttcacggtcgcgttgggcgctgtcgcggcgcaagtcatcagcgaggtcgctggcgacaataagggcgtgttcgtcgctggtgataaccgcgacgtggtgagaaagggtcatgagtttctccagaagctcgtggaaaaagtgttctggtcggttaaatccaggagtgacgcgccggtaaagtgccgttcaagcgataggcaccgatagcgtggtacttccagcgcaccgggtcgtgcagggtgtgcacccgggcgttgcgccagtgacggtcgaggttgaattcggcgagggtggcgcggctgccggccagttcgaagagcttctcggtgaccagcaacgacacttcagtggtcagcactttcgcttcggccaccgcgattgacgcgcgcgcggcagattgcgcggtgattggcgcggcgctgacctcgtcgagcacctggcccgccttgcgcagcagcgcttcggcggcgtgcagttcgatcttcaacttgccgatatcggcgatcacatacaggtcgtcgctggcccgttcgaccttagcgtcgatccaggggcgcgaacgctcacgcacgaaggcgatggtgtcgtccagtgccccacgggcgatgccggcgtcgatggcggcctggatcaactgcgacacggcaccctggatgttcgggctttcgcccaggcgccagttgtcgatgaccagctccgggtccaccggcacccggtcgagcagcacagtgccgctggcggtggtgcgttggccaaagcccgaccagtcatcgacgatgcgcagcccttcgctgccgcgccttatgaacgccatgacttgcttgccgtcatcgttcagcgccttgatcgcaacccagtgggcaaacagcgcgccggtggagtagaacttctggccgctgaccaccaacccgtcaccttcggccgtgaggcgcgccttgagctccaaggtgtttttggtgccgcgttccgggccgccgttgccgatgcgccagccgtcgagcacgctctggaacagctgctttttctggcgctcggtggcggtgttctgcaacacatgcaggatgccgaaatggttctgcggaatctgcccgagggccgggtcggccgcactgatgatcgcgaagacttcggccagggtcacgaacgacacctgcgggccaccgtattcgcggggaattgaaatactgcccaagccgctgcgggtgaattgttcgagctgtgcccacggcagcttgcgttgctggtcgcgcttggcggcctgcaagcgtgcagcctgggccagctcgtgggcggcgctcagcgcctgggcgtcgtcgcgcagcaccgtggccggcaacagcaggggggctacgtccagatcactctgggtgggtgttagagccaagttagacatcagcgccgctccttggctgcacgcaatgccctggcgttatgcaccggggtaattctgaccataccgacctcgcattcgatgaaataaaaactgaaaaatcaggaatgtccggtggtccggtgcatataccctaagcgtgttaattctttaaataaactaacttttaggaatatgcatagaagggctgtcaccccggttcacaaggtgagccgaagcgacgcggttgatagcctggcgcgggcgaggcagggcgggtcgttgctgctgatgcacaggcggcgatgcgcaaagtgcgggcgggtgcccagctggaattattaccgacgcaatcaaggatgcagtaggtaacttccaaccggcagtcgtcgcccgcttcgataatcacttgggagggcacccacacctgtactgccaggcctacgttcctggcttggattttcggcaggtccaggcgtacatccccccagcgcagggtgatggcatcgccggtgctcatgttcaagtaaggctcgatcgtcagcggaatgccgcgtcgtacctggcagctgttgacgccgtagcggcggatggtttcaggcaggctgacgggggcgaggttctggttttcatcacctctttcgtggttcagatgagacgagggcaggccgccggggtagttggtcttgacccgcaccagggtcgcggccgagcgcataggcccatggccgatctgcaggacctggtagtggacgcgcgcggggccgtcctgcacaaagctctccggtacccacaggtgggtgaacgtgccgatcttgccagcggtcaccttgcgcgaggcggcgaagcagttgttccagaacagttcgatcaggtcgccttcttccatgcctgggtagggtgaaatatcgacttgcaagtgcgtggaggccagggcgctgatgccgcttccaatcgcctggggcaatttgggggcagtgagcgtggccggggtttgggtgtgtgtcatcagtaatctccttgatgcagccagcagcaatcgttccgagcccccggcgcacaggcgcaaggcggttcgaaaggaacgattcagtcagtagccgggataggatccaatcctcaaggcgctagataagagggttggccgcagagcgtcaatggaggcaaaaggctaaacggcgggtttgaagatattcagaagggtctgacggggagggggattttaaggtcgttacggcggggtattttaagcgctggaatggtaacccgttgtaggagcgagcttgctcgcgaagaacgtcaacgacaacgcggtgaatcagattgaccgagttgtctgggcgcttttcgcgagcaagctcgctcctacacggggtgggtcagtgggcgaggaatttgctcagaaactgccgggtgcgctcttccttggggttggcgaacaacgccttggcttcgccctgttcgacgatcacgcccttgtcgaaaaaaatcacccggttggccacatcccgggcaaagctcatctcgtgggtgacgatgaccatggtgcgattttcttcggccaggctgcggatggtcgccagcacttcgcccaccagttccgggtcaagggccgaagtgggctcgtcgaacagaatcacctctggctccatggccagcgcccgggcgatcgctacgcgctgttgctggccgccggacaaccgccgtgggtaggacgcttccttgcccgccaggccaacccgctccagcagcttgcgccccaattcggtcgccgcttcccgcggcatcttcttgaccacgatcggcccttcgatgacgttttccagggctgtgcggtgcgggaacaggttgaagttctggaacacgaagcccacatgctggcgcaggcgccgcaccaagccctgttgctggttgagcggcttgctgccgtcgatctcgatgtcaccgaccttgatacggccgctggtgggttcttcgaggaaattcaggcagcgcaggaaggtggtcttgcccgaaccgctgggaccgatgatggcgactacttcgccttccttgacctccaggtcgatgccgttgagcaccacctgaccgttgaattgcttggtcagtttttcaaccacgatcatgcttcaagactccaggtcatgccggttgacccggtcttccagacgattttgcagatgcgccaggatgctcgccaggatccagtagatcagggccgcggacagatacatggtgaaaatttcgaaggtacgcgccgacaccagttgggcctggcggaacagctccggcacctggatggtggcggccagcgcggtgtccttgaccagcgaaataaagctgttgcccagtgggggcagggctgtacgcatggcctgcggcaggatggcccggcgcagggtctgcgcacgggtcatgccgatactggcggcggcttcccattggccacgctcgatggaggcgatggcggcccgcaggatttcacaggcgtaggcggccatgttcagcgaaaagccgatcatggccgccgggatcggatccagctcgatgcccacttgcggcaagccgtagtagatcaggaacagctgcaccagcaagggcgtgccgcgaaagaacgacacgtagaccctggccgtccagctgagcaatttgaagcgcgacaggcgcatcagcgccaggccgaagcccagcagcaagccgaaaaacatcccgccaaggctgaggattaccgtgtagtacgcgcccttgagcagaaagggcgcggagtccagcgcgagttgaaagcctgcttccattattgggtgacgtcagcgttgaaatacttctcggacagcgctttcaaggtgccgtcggcgcgcagcttgtcgagggccttgttcaccgcgtcgagcagttcaggctcgcctttgcgcagggcaatcccggattcctggcgtgagaaggcgtcgccggctgcggcggtgtccttggctttcttggcgtactccagggcggccaggcgatcaatcaggatcgcgtcaatacggccgatgcgcaggtcctggaacttggtcgggtcgtcgttataggtcttgataatggctttaggctggttgtccttgagccattgttcgtagttggtgcccaggcccacgccgactttcttgccggccaggtcggcggcggtcttgatggtgtcgacgttcttcgcgagggtcagcgcctggataccggaaacggtgtagggcttggagaagtcgtacttcttcttgcgctcttcggagatggtcacttggttgaccacggcgtccaggcgcttggattccaaggcggcgaggatcccgtcccacggggtggcctgtagtttgaccttgacgcccaactccttggccagggcttcggacaactccacctcgaacccgctgagcttgccgctttcatcgacgaagctgaagggtggataggtgccctccaggccgatcttgatctcgccggccttcttgatgttgcccaactgctcgccggcaaccgcctggcccagccagccagcgccaagcgccaggcccaatgtgccaaccaacagcgtgcgacgcaatacagaaatagtcatggagagcccctgtgtttttatggtgagcgaagcaggtgacgcggtagtcgtatcctgccttaaagcgcggtgtgcgtcttcgccttcggcgcgatgataaagctggattttaagacttgaaaataataaaaaattaatttcatatactatttttgcctaaggaggccctcccacactttggtctgtgtccgtttaattgaaggctgaatcgtaggcaaacaacgccggcgccccaccggtatgcaggaaaatgattggcccttcttcaaggcgctgacgcccgatgccgtccagcaacccggccatggccttgcccgtataaacagggtccagcagcagaccttcctggctggccaaaagtttgatcgcggagagggtgccagcattcggctcgccataacgggggccgaaatactcgtcccacaggatcaccttgaaggcttcaggcatatccataccgagcaactcggcagtgcgttcggccaggccctgcactttggggaactgcgcttcttcggtgcgcgacacggtaatgccgatcaccggcaacttcggcagcacttcgcttaacgccagggccaggccactgtgggtaccggcgctgcccgaggcgagtaccacggcggcgaattcaatcccgctgtcttcaatctgcgcggccaactccagcccggcacgcacatagcccaaggctccgagggcattggagccgccgatcggcaccaagtacggtttcttgccattgctgcgcaggagggcggcgagggcgttgagctggtcatcggcctgttcgaggttttccaccaattccactttggcgtcgaacaggtccagcagcaggcggttgccgttgcccagatagttcgggtcttcggtgccggtagggttctccagcagggcgacgcatcccaggccaagcttggcggcgagcgcggcggtctggcgcacgtggttcgactgcaacgcgccggcggtaatcagggtgtcggcgccctgggcgatagcgtcagccgccaggtattcgagtttgcgcagcttgttgccgcccatggccagcggcgtggtgtcatcgcgtttgacgtagatgtccctgcccagccaggccgacagccgctcgagcttttccaaagcggtagcaccgcccagcagttccaaacggttaaaacggtcaagctgttgtttgatcatggctacacacggtgactgagtgatgtgggggactataggcaggcccttttcatcgggcaaccggcaatcgcttatgccggatagttcttatgttcataccattggttcttaagagctgccacggtgcataccgtaaagtgatggccatttcgtcaggagtgaataccgtgagtgagcgttccagtcattggcaattgcagaccatcgtcagccagctgcgcggcgcccgcgaccagtggcgaacgcgcaacggacgcttgagcggcgagcatggtggccgcgagctgccgtcgcgcgaggcggtggcgcagatacttgaagccttgtgcggtgcactgttccccatgcgcctgggcccggtggacctgcgcgaagaaagcgaagatttctatgtagggcacaccctcgacgtggcgctcaatgccttgctcgcccaggcccgcctggagttgcgctacgccgcacgccagggcggtgaggacgacagcggggtggacgcccatgccatccgcctgatccaggatttcgccctggcgctgccgtccctgcgcagcctgttggacaccgacgtactcgccgcctaccacggcgacccggccgcccgcagtgtggatgaagtgctgctgtgctacccgggcatcctggcggttatccaccatcgcctggctcatcatctataccgggccggtttgccgctgctggcgcgaatcagcgcggaaatcgcccactcggcgaccggcatagatatccaccccggtgcgcagatcggcccgagcttctttatcgaccacggcacgggcgtggtgattggcgagaccgcaatcatcggcgagcgggtgcgcatctaccaggcggtgacactgggcgccaagcgctttccggcggatgaggatgggcagttgcagaaaggccatccacgtcacccaatcgttgaggacgatgtggtgatttatgctggggcaacgatcctgggccgcatcaccatcggcaagggctcgacaattggcggtaatgtgtggctgacccgcagcgtgccggctgaggcgaatatcacccaggcgaacttgcagcatgatgatggggcgcagaagtaaccgcgcactcaggcactacacaaaaccaatgtgggagggggcttgctcccgatagcggtggatcaatcagcttatctgtagctgacccaccgtaatcgggagcaagccccctcccacattgtttaatcgcatgttcaaattcacatgtcatcactgaacgatttgtcatttagatccgtcataccaatccttgagctagtgtagaaatcacctaccattcggccctgcaattagtcccagaccgcctattcatgtttaacttgaacgttcgttcaagtttaaccggtggttcgctgcccgctcacaacaggaggcttacctttgctgagtccgttatttacagccacatcccacaccccaggggtgcatcgttcatgagtgcatcgtccaccccatccagcggcctggtgcgcatgaatgcgcccgttttctactttgccgcgacttttatcctgctgtttggcattaccgtcatcgctatcccgcaacaggccggcgcctggctgctggcggcgcaaaactgggcggcgaatacggtcggctggtactacatgctggcgatgaccctgtatctggtcttcgtggtggtcaccgcgctatcgggctacggcaagataaaactcggtgccgaccacgacgagcccgaattcagttacctgtcctgggccggcatgctgttcgccgccggcatcagtatcacgctgttcttcttctgcgtctcggaaccgttgacgcacttggtgcaaccgcctcaaggcgaggcgatgaacgccgatgcggcgcgccaggccatgcaggtgctgttcctgcactggggcctgcacggctggggcgtgttcgcgtttgtcggcatggccctggcgtatttcgcttaccggcataacctgccgctggcattgcgttcggcgctgtacccgttgatcggcaagcgcatcaatggccccatcggttacgcggtggatggcttcggcatcatcgccacggtgttcggcctgggcgccgacatgggctttggcgtgctgcacctcaactccggcctggactacctgtttggcattgcccacacccagtggatccaggtgggcctgatcaccctgatgatgggcgcggcgatcctcgtggcggtggccggggtcgacaagggtgtgcgggtgatgtccgacatcaacatgctgctggcctgtgcgctgctgctgttcgtgttgtttgccgggcctacccagcacctgctcaacaccctgatccagaacatcggtgactacctgggcgcattgcccaccaagagtttcgatgtgtacgcctacgacaaaccgagcgactggctgggtggctggacagtgttctattgggcctggtggatcgcatggtcgccattcgtgggcctgtttatcgcccgtatttcccgtggccgcaccatccgtgaattcgtgttcggcgtgttgttgatcccgctgggcttcaccctggcttggatgtcgatcttcggtaacagcgccatcgaccaggtgctcaaccatggcatggtcgcactgggccagtcggctatcgatgatccgtcgatgagcctctacctgctgctggaaacctacccgtggagcaagaccgtcatcgccgtcacggtgtttatcagctttgtgttcttcgtgacctcggcggactccggcaccgtggtgctgtccaccctgtcgtccaaaggcggcaacgccgacgaagacgggccgaaatggctacgggtattctggggcgcgatgaccgcgctggtcaccagtgccttgctgtttgccggcagtatcgactcactcaagtccgcggtggtactgacctcgttgccgttctcgctgatcctgttgctgatgatgtgggggctgcacaaggcgttctatctcgaatcgcagaagcagattgcccagttgcattccctggcgccgatttcggcgtcgcgcaaaggccgtggcggttggcgccagcgcctgagccaggccgtgcacttcccgtcgcgcgatgaggtgtatcgcttcctcgaatcgacagtgcgcccggccatcgaggaagtcacggcggtgtttgtcgagaagggccttaatgtagtcactcagccagacccctccaacgacagcgtcagcctggaaatcggccatggcgaggagcatccattcatctaccaggtgcagatgcgcggctacttcacgccgtcgttcgcccgcggtggcatgggctccaaagagatcaacaaccgccgctattaccgggcggaagtgcacttgagcgagggcagccaggactacgacctggtgggctacaccaaggagcaggtcatcaacgatatcctcgaccagtacgagcggcacctgcagttcctgcatctggtgcgctgagtaatatgcggtaaagcgttcctctcaagtaggcctttgctgtaaaaggaagaggcagacttaagcgattcagctgcttaaaaggcctgggaatattgatattcccaggccttatttgccccagctcaagagaggattcgatgacgtacattgctgccgaaaaccgctatgaatctatcccttatcgccgcgtaggtcgcagcggattagtgctgccggcactgtccctggggctgtggcacaactttggcgacagcaccccgatcgacacccagcgcgccctgctgcgcacggcgttcgacctgggcatcaaccatttcgacctggccaacaactacggtccgccctacggcagcgccgagatcaactttggccgcttgctgcgcgaagacttcaagcactatcgcgacgaattgatcatctccagcaaggccggttgggacatgtggcccggcccctacggccagggcggcggttcgcgcaaatacatcctggcgagcctggaccagagcctgcaacgcctgggcgtcgactacgtggatattttttactcccatcgttttgaccccgacacgcccctggaagaaaccgccagcgccctcgccaccgccgtgcaacaaggcaaggcgttgtatatcggcatctcctcctattctggtgtgaagacccgcgaaatcgcagccttgctcaatgagtggaaagtgccgctgctgatccatcagccagcctacaacctgctcaaccgctgggtggaaaaagacctcttggacaccaccgaagagctcggtgccggggtgatcgctttcacgccactggcccaggggttgctcaccgataaatacctcaacggcgtaccggccgatgcgcgggtcaaccgcccgggtggcggctccctgcaagcccagcacctgtccgaagccaacatcgcccacgtgcgcgcactgaatgaaatcgccaagcgccgtggccagagcctggctcaattggccctggcgtggacattgcgggatccacgggtgaccagtgcactgatcggcgcgagccggccggagcagatcatcgagaatgtcggggcgttgcagaacctgagcttcagtgctgaggaactggcggagattgatcggtttgcgcaggaaggtgggatcaacctgtgggaaaagccgtccactgctgaataactgacacaacggggtcaaaaatgtgggagggggcttgctcccgatagcagtgggtcagctacagatgagctgactgaaccaccgccatcgggagcaagccccctcccacatttggttttcagtgtggcgactagaacggcacatccccaagaatcgtcgcccggtgcatcacccgccgctgtggccggtagtcatccacggcgtaatgctgggtcacgcggttatcccagaacgccacgtcattttcctgccagcgccagcgtatggtgaattccgggcgggtggtgtgggcgaacagcagcttgagtatcgcctcgctttcagtcggctctagttcattgattttggtggtgaagccttcactgacaaacagcgacttacgcccgcttaccggatgcgtgcgcactacggggtgcgacagcggtgggtttttctggcgggtttgctcccagcgcgccaggtcttcggcgctgttgccgaagcgctccagcgggaaggacttggtgaagtcgtgagtggcagtcaaccctgtgagcagtgccttcagtggcgcggacaaggcttcataggcggcaatgccactggcccataatgtatcgccgccaaaagccggcagcagcttggcactcagtaccgcgccgagtgctggagtgggcaggaaggtcacgtcggtgtgccacacggcattgtcgcgcacgtcggtgacggcggtgtcgaggatcagcacttcgggctgttccggcacgttagggtagatcgggtgaatgtgcaggtcgccgaagtgcgccgcgaaccgcgcttgctgctgcggggtgattgcttggccccggaagaacagcaccgagtggctgagcagcgcctgctcgatggcatcgcgatgtgcctcgctcagcggctgggtgatatcgacgccactgatctgggcgcccagggcggtgcttaatggggtaacggtcaggctgctcaattgagttctcatcacttagtgtgcctggccatgccagggcactaatttacgctgcagggcgcgcaggcccatttccatggcgaaggcgatcagggcgatcaccaggatccccagcaccaccacatcggtgaccagaaactgcgccgccgactgcaccatgaagcccaagccgctggtggctgcaatcagctcggcggcgaccagggtcgaccagcccacgcccaggccgatacgtaccccggtgaggatgtcgggcaaggcgctgggcaggatcacatggcgaatcagttgtgcacgggtggcgcccaacgactgagcggcccgcagcttggccgggtcgacggtacgcacgccggttgcagtggcgatggcaatcggggcgaagatcgccaggtagatcagcagcaccttggacagctcgccaatgccgcaccagatcacgatcagcggcagataggccaggggcggaatcggccggtagaactcgatcagcggatcgagaatgccacgggcgatacggttggcaccgatggcaatccccactggtacggcggtcagcaccgcaaagcccaggcccaggccgatacggctgaggctggcgcccaagtgctgccataaggtggagtccatgtagccggtggtcgccagtagccagcctttttgcagcacggcggacggtggcggcaggaacagaggttcgatcaagcccgtggcggtcaccgcccaccagagggcgagcagggcgaccagggtcaggacgctgatccaacgcgtgctcaggctgcggcgtaccgggacagtggcgtgcgccaccggcttgctggccgtggcgggaagttcgtagctgctcatgcatacacctgccgttgggagaacaccttgcccaatacgtgctcgcgggtttcgataaagcgcgggtcggacttgatcgcccgcgccgactccccagcggcatagcgtcggccgaaatccagctgcaggcgttcgacgatctggccggggttgggtgccagcaggatcaggtccgtggcgaggaacaccgcttcttcaatgtcatgggtaatcaggaataccggcttggcggtgcgacgccagacttgcagcagcagctcttgcatctgttcgcgggtgaaggcatccagggcgccgaagggctcgtccatcagcaatacccgcgggtctgccgccaaggcacgagccagaccgacgcgttgcttctggccaccggagagttgccagatgcggcggctgtcgaagccggccaggtctaccagagcgagcatttcacgggcgcggacttcgcgctgctccttgggcacgccggccagttcgaggccgaaagccacattggcgagcacgtcctgccagggcagcaaggcatcgtcttggaaaaccacgccgcgttcggcgctggggcctttgaccggcacaccgtcaagggtgatgcgcccggcagacggttcgacgaaaccggcaatcaggttcaacagcgacgtcttgccactgccggacgggccgagagcgaccagcagttgctggggcccgaggtccagggatatgtcagacagtaccggttccggggcgcctgggtactgtgcgctgatgcgctccagttgtagcaaggccatcgcgatcaactcctgaatcagtgggtgatgaactgggcgctgacgtaaggggcgtagtccggcagcacggcgtcgaccttgttttgttccttgaggaacgcagcggtgtcggtgagggcctggatggtcggtgcgcccagcagggtgacctggtcagcggccagcgggtagacgttgccttgcagcagcaaggggatatcgctgggcttggcgcctgagagtttcaccagcttgtcgacgttgcctgtgtcggcgagccaggcttgtgggtctttgcggtaggaggcgtaggcatccagggtgaccttggcgaaggcggtgacgatgtccgggtgcttctcggcaaaatccttgcgcacaatccaggcatcgaaagtcggcgcaccgaacttggccagctcgccggaggtgatcagcaccttgccattttccttggctacgcccagggcggggtcccacacgtaggtggcgtcgatatcaccgcgcttccaggcggcgatgatggccggcggcgcgaggttgaggatggtgactttggccgggtcgatgttccagtgtttcagcgcggccaacaggctgtagtggccggtagaaacgaagggtacggcgatctttttgccgatcaggtcctgggggctgttgatccctgaaccgttacgcgccaccagtgcttcggcgccgccgatctgggtggcgaccaggaaggtttgcaccggcaccttacgggttatcgcggcggtcagcgggctggaaccgagatagccgatctgcacgtcgccggaggcgatagcggcaatgatgtcggcgccattgtcgaatttgcgccagtcgatcttggcatgggtggctttttcataggcgccgtcggcttgggcgactttggccgggtcgacggtggtctgataagcaatggtcacgtccgccgcctgggcaaacaggctggcaccggccagggataacgcggccaacaggcgcagaggggtcagcagtttcaaggggaagctcctcaatcaggcggccgaggttcggcgtgtgaggagactaaatgatctaagaactacaaaataaataactttttagaattagcttatgaagcaaattctgcgcatgcgagggaccaatgtgggagggggcttgctcccgatagcggaatgacagtcactggatgattgactgaaagaccgtcatcgggagcaagccccctcccacacaagccatcagttgctgattgcgaggatactggcctggtacgacccgacaaacacatcgaaatcgcccacttcgttctgctccagctccgcctgctgtgccagcgatgtgcgggcctgctcttcgaagcgcgcctgctctagggcagccaacggctcacggcggaagtactcggcatgcacctcgctctgatgcagggagaattgcgcaaaactctccttgcgctcggccatcgccgccagcacctgggccgaaggcgtcagggacgaatccttgaccttggccaactgggcatccagcgcctcgctgtgttcggtgatgccgtgactctcatcgagcagggcggccaggggggcaatcttctccagcaactcggcagcccattccttcatgtccaccgcctgaccttcgcgctgcaattgcaggcccggacggcgaccttccttgaccacgctgagaaagttggacgtggcattcccacattcgttattggcaaacagcgggctgtcgttcaatgcgcaatacagcaggaacgcgtcgaggaaacgcgactccggcaggtcaatacccatcggcaggaacgggttgatatccaggcagcgtacttcgatgtactggataccgcgggccatcagcgcctggatcggccgctcgccagtgtaggtcacgcgcttgggacggatgttggagtagtactcgttttcgatctgcaggatgttggtgttgagctgcacccactcaccatccttgtgcgtgccgacttcgacgtatggcgcgtagggtgttgccaccgcttcgcgcaggctgtcggtgtagctggccaggtcgttgtagcaaggcgtcaggccggcctgggcgttgctctggtaacccaggtcgctcatgcgcaggctggtggcgtagggcaggtacagggtgtcgacatccaggacttcaagctggtgcgagcggccgcgcaggaaaccggcgtccagggctggcgaggcaccaaagaggtacatcaacagccagctgtagcgacggaaattacggatcagcgcgatataggccgtggactgatagtcacggtcggtaccgacaaagccttcggcttccttgagcaacggccacagctgttccggcagcgagaagttgtagtggatgccggcgatgcactgcatggtcttgccgtaacgcagggccaggcctttgcggtacacatacttgagctggccgatattggaggtgccgtagtaggcgatcggaatatcttcctcggccggtaacgggcacggcatcgaggggctccacaggtattcgctgcccagcttggagtaggcaaagcgatggatcttgtccaggctgcccaaggtatcggccgggtcgggcagggctggggtgatgaactccagcagcgattccgaatagtcggtggtgatctgttcgttggtcaacgcagcgcccagggcttctgggtgcggcgtttgcgccaggcgaccctcgctggtgacgcgcaggcattcacgctcgatgccgtgcaagcactgctctagcagggagaggtgttcgcgcttgccgagcagggccaggcggcggttgagaagttcgctcaagttggattccttcacgcgtcagtcgccccaatatgggggtgggcaggacggtctacaagggtgaagttgaaactggcgtgatcgcctggttctgagtcgatttaacccgctctgaatatgccgacttcactccatgaattgggctacagcgcagcgagaaaattccgacgctgttatcgcagcgccgaaattaactcaaatcgagggtggggagctataggacagcgaacgtgccctgcgcttttgcgacaagtctttcgccctggtacacgtcggcttcgaccaccaacgtgcgccggccggcgtggactacccggctggtgcacagcacgtcaccgtcttcgacggcgcgaatatagttgatcttgcattcgatggtggcgctctgctggtcgaaaccatgggcgctggaacaggccaggcccatcgtgatgtccaccaggctgaaaatcgccccgccatggagcttgcctgcacggttgcgcaggtgcggctccagggtcagggccacctcggcaacgccttcatccaggcgttgcaggcggcagccgatcagctcgctgaacgcgctctgggtcaaacccgccgggatttccatcaacgcttcttcaactgtttggcattagcgaacagcgatgccatggcgttgttgctcggcgcggccgtcgcggtttccttgcgtggcgcgttgttttgcgactggcgcggtgccgagcccggacgcgcgccacgggcgccgtcgattttctcgccaggggtgtcgctcatgcgcatcgacaggccgacgcgcttgcgcgggatgtcgacttccatgaccttgaccttgaccacatcgccggctttcaccgcttcgcgcgggtccttgatgaatttctccgaaagcgcggagatatgcaccaatccgtcctgatgcacaccgatatccacaaacgcgccgaagttggtcacgttggtcaccacgccttcgaggatcatgcccggttgcaggtccttgaggtcttcgacaccgtcctggaactcagcggtcttgaactccgggcgtgggtcgcgtccaggtttttccagctcttgcaggatgtcggtgatggtcggcacgccgaaggtttcgtcggtgtacttcttcgggtccaggcgcttgaggaacgcggcatcgccgatcagcgaacggatatcgcgatcggtctcggcggcaatgcgctgcaccagggggtaggcttccgggtgaactgccgaggcatccagcgggttgtcgccattcatcacgcgcaggaagccggctgcctgttcgaaggttttttcacccaggcgtgcgacttttttcagcgcggcgcgggttttgaacgcgccgttctcgtcacggtggctgacgatgttctgcgccagggttgcgttgaggccggaaatgcgcgccagcagcgccacggaggcggtgttcacgtccacgcccacggcgtttacacagtcttccacgaccgcatccaggccgcgcgccagtttcagctgcgacacgtcgtgctggtactggccgacaccgatggatttagggtcgatcttcaccaattcggccaatgggtcttgcaggcgacgggcgatggagacggcgccacggatcgacacgtcgaggtccgggaattccttggaagccagctccgacgccgagtacaccgaagcacccgcctcggagaccatgaccttggtcatcttcatggccgggtattttttgatcagctcagcggccagcttatcggtttcgcggctggcagtgccgttgccgatggcgatcaggtccaccgcgtgcttggcgcacaaggcggcaaggatcgccaaggtctgatcccacttgttatgcggtacgtgtgggtacacggtggcgtggtccagcagcttgccggtggcgtcgaccacagcgaccttgcaaccggtacgcaggcccgggtcaaggcccaacgtggcacgcgggccggccggtgcagccagcagcaggtcgtgcaggttgtgggcgaacacgttgatcgcctcggtttcagcgccgtcgcgcagttcgccgagcaggtcggtttccaggtgagtatagagcttgaccttccaggtccagcgcacgacttcaccgagccacttgtccgcaggacggttctgattttggatgccgaattgttgagcgatcatgccttcgcacgggtgcatggcgcccggtagctcctcgccgactttcagcgaggagctgagaataccttcgttgcgaccgcggaaaatcgccagggcgcggtgggacggcatgcttttgagcggttcgtcgtgctcgaagtagtcgcggaatttggcgccttcttcctctttgccggcgataacacgggcgctgaggatggcttcctgcttcaggtaggtacgcagtttttccaggaggctggcgttttcggcgaagcgctccatcaggatgtacttggcgccttcgagggcggccttgacgtcggcgacgcctttttcagcgttgatgaagcgagcggcttcgctttccggcgtcagcgacggatcgtcgaacaggccatcggccaaatcaccgagaccggcttccagggcgatttgaccctttgtacgacgtttctgtttatacggcaggtaaaggtcttctaggcgggtcttggtgtccgccagcttgatgtcgcgttccagttgaggggtcagcttgccctgttcctcgatgctggcgaggatgctgatacgccgttcgtcgagttctcgcaggtagcgcaggcgctcttccaggtgccgcagttgggtatcgtcgaggctgccggtcacttcctttcggtaacgggcgatgaaaggcaccgtggagccttcatccagtagagcgacggccgcttcgacctgttgtgggcgtacaccgagttcctcggcgatgcggctgttgatgctgtccatataaccacctgaaattcttaaaatcagctcgccagcccgtaaaaacaaggcccggcaaggctggttgagcggcccgactggcgccgctgcctgggtcaagaggctgcctattgaccctcgaaatcgaaaaagtcacgacaagcgggtaaaaaaagcccggcagcaaacggtaacgatctgacgttgccctgcacggaggcgccgcattataaccagcgttctgcctttgggggctactgcgccgcaggtgttagggcgtgggttcgctggcagtagatgaaaaatctgctaacaatgcacacggtgcgtataacggcagctacgccataatgcgcgccgagataagaggagcatccaatgagcagcaccgcacaaactgctgaaggcgaaaaaattctcatcgttgatgacgatccggggctgagcagccttctggagcggttcttcaactccaagggctaccgtgcccgcgcggtgccgaacaccgagcagatggatcgcctgctggggcgtgaagtgttcaacctggtcgtactcgacctgatgttgcccggcgaagacggcctcactgcctgcaagcgcctgcgcggtgcgaacaacctgattccgatcatcatgctcaccgccaagggcgatgagctgagtcgtatcaagggccttgagctgggtgctgacgactacctggccaagccgttcaaccctgacgagctgatggcgcgggtcaaggctgtattgcgtcgccaggcagcacctgtgccgggtgcaccgggcagcgaagacgaaagtgtcacctttggcgactacgagctgtccctggccacccgtgagctcaagcgcggcgaagaagtgcacatgctcaccaccggcgaattcgcagtgctcaaggccttggtgatgaacgctcgccagccgctgacccgtgacaagctgatgaatcttgcccgtggtcgggagtgggacgctctggagcgttccatcgacgtacagatctcccgactgcgccggatgatcgagccggacccgtccaagccgcggtacatccagacggtgtggggtgtgggttatgtgttcgtgccggatggcaccgctaccaagtgaccgatgatttgcaggggcgggtatcctgacgtttgactccatgagggtcgacgggatgcccggcgtctgcaattctgcgagcgccgttcgtttctgcaaggtgtgcagctttcatctatgaaaaccccgctgtggttcccgcaaagtttcttttcccgcaccctttggctggtgctgatcgtcgttctgttttccaaggcgctcacgctggtttatctgttgatgaacgaagacgtgctggtggatcggcagtacagccatggcgtcgccctgacgttgcgtggttattgggctgtagaccctgagaaccgagaaaaagtggccaaggcgtcgaccttgacccgggttgatggtgccggcgtgccggaaggcgagcaacattggccttacagcgagatctaccagcgccagatgcaggccgaactcggagccgataccgaggtgcgcctgcgtatgcatgtttcgcctgcactgtgggtacgagcgccgagcctgggggatgcctggatcaaggttccgctgtacccgcacccgctgcgtgggcagaagatctggaacgtattgggatggttcctggccatcggcttgctttcaaccgcgtccgcgtggattttcgtccgtcagctcaaccagcctctcaagcgcctggtgtttgccgcccgccaattaggccaggggcgcagcgtgcgcctgccggtcagcgacacgcccagtgaaatgaccgaggtgtacggcgccttcaaccagatggcggaagatgtcgaacaggctgggcgcgagcgggagctgatgctggcgggggtgtcccatgacttgcgtacgccgttgacgcgactgcgcttgtccctggagttgatgggcgaccataccgacctgaccgatgacatggtccgtgacatcgaggacatggacgccattctcgaccagttcctggcgtttatccgcgatgggcgtgatgaggtggtggaagaagtcgacctgacggacctggtgcgtgaggtggttgcgccctataaccagaacggcgagcaggtgcgcatgcgcctggagccgatccagccattcgcattgcgccgggtgtcgatgaagcgcctgctgaacaacctgatcggcaatgccttgcatcatgccggttccgatgtggaagtggcagcgtatgtatccggtgacagtactgcaccttacgtagtgctgagtgtgatggaccgcggcgcggggatcgacccggctgaacttgagggaatcttcaacccctttacccgtggcgaccgtgcccggggcggcaagggcacgggcttgggcctggcgattgtacggcgaattgcctcgatgcatggcggtaatgtggagctgcgcaaccgtgaagaaggcgggttagaggcgcgggtgcgcttgccgcttgggctgatgttgcctagggatgcggtctgactggtgacataaatcaaatgtgggaggggcaagccccctcccacattggttttatgttgggcctaaaataggtttttagcctttgcccttggtccgagtcatattcggcccgccgttcttctccagatgctgaatgatgatccccgccacatccttgccggtggtggtctctatcccttccaggcccggcgaggaattcacttccatcaccagcggcccatggttggagcgcaggatatccacccccgctacactcaaacccatcaccttggccgcccgtagcgcagtcatgcgttcttccggggtgatcttgatcaggctggcgctgccgccacggtgcaggttggagcggaactcaccgggcttggcctggcgcttcatggctgcaatcaccttgtcgcccaccacgaagcagcggatatccgcaccgccggcttccttgatgtattcctgcaccatgatgttctgcttgaggcccatgaatgcctcgatgactgactccgccgccgtcgcagtttcacatagcacaacgccgatgccctgggtgccttccagcaccttgatcaccagcggcgcgccgttgaccatctcgatcaggtcgggaatgtcatccggggagtgggcaaagcctgtgaccggcaggccaataccccggcgtgacagcaattgcagcgaacgcagcttgtcccgtgagcgtgcaatggccacggattcattcaggggaaatacccccatcatttcaaactggcgcaataccgcgcagccataaaacgtcaccgaggcgccgatacgcgggatcaccgcatcgaagccttccaggggtttgccccggtagtggatctgcggtttgtggctggcaatgttcatgtaggcacgcaacgtgtcgatcaccaccatttcatggccacgttcggtgccggcctcgaccaggcggcgggtggaatacagacgcgggtttcgcgacagcacagcaatcttcatgcagcacctggggcagaaatagtggagaccgggaacaccggcttgtcttgaacgtacttgacgccggggctgaccaccaattggccgtcaatcaaggctttggaaccgagcagcaggcgatagcgcatggccttgcggcaggcgagggtgaactccacccgccacacccgatcgcccagcgccagggtggtactgatcacgtagcgcacctgcgcatgaccgttggagctcttgatggttttcatcgtcaccaggggcgcttcgcagcggcggtgacgcaactgcaccacgctgccaaggtgcgcggtaaagcgcacccactgttcaccgtcgcgctcgaagggctcgatatcggtggcgtgcaggcttgaggtgctggcaccggtgtcgatcttcgcgcgcaggccagccactcccaggtcgggtagtgccacccactcacgcagacccacaacggtcaaatggtcaaatgtcttcaatatgggtaaccggttaattcgcccatgcctgaggagagacctcggccaaggctttgaatgcgggcctggcgaaccagtagccctgcatcagaaatattccgcagtcggacaggaagtcgcgctcgccggcactttcgatgccctcggcgatgacagtaacccccaactgctcacagattgtgacaatcccctggacgatcacctggcggacacggtcctggtcgacatcgcggatcagtgccatgtcgagcttgatcaagtcaggttggaaatcggccagcagattaagccccgaatagcccgcgccgaaatcgtcgatggcggtcatgaagccgaattcgcggtattcacgcagaatattggtcaaatggcgatagttatctacgtgctcgtgttccagggtctcgaagatcagccgatccagaggaaagttatgcgcccgcgccgcctccaaagtgctgcgaatacacagttcaggccggtatacggcattcggcatgaaattgatggacaggcgggtttgcattcccaaggcagaagccccggcgatagcctcggtgcggcagcgctggtcgaagcgataccggttgctttcattgacccgctccagcaccgacagtgcgccttcgccatgcgtgcctcgcaccagggcttcgtgggcgaaaatagaatgatcgcgaaggtctacgataggctggtaggcgaaagcgaaatcaaagcccaggggctcgctttgctggcaacccacgcaccgctggccaggcgaggtgagtgaaacgggaaagtcggtcacagcggatcctcgcgaaatcagggtactacctggcgtatcttaggtgagccttggggtttatgcgtcgaagggtttcaacggtaaagttgcgacatttttcagagcgaggaattcaagtggctcaaaagcaagaagaggaagaaaaggtccggctggacaagtggttatgggcggcgcggttctataagactcgggccctggccaaggccgctatcgagagtggcaaggtgcatcatcgaggcgagcgctgcaagccgggcaaagagccgcgtatcggtgatgagtttcagattcgtacaggttttgatgaaaagactgtcgtggtgcaggcgctttctgtcgtacgccgtggggcacccgaagcgcaggcgctgtacaccgaaaccgaagcgagtatcgccaagcgcgaaaacgccgcggccatgcgcaaggccggggcgaccggcatgaccaccgatggcaagccaagcaagaagcagcgccgcgatctattcaagttccgcggcagcggcaacgacgattgatgacacatgtccccagcttgaaggagatcaaaaatgtgggaggggcaagccctctcccacattaagcctccggtgctaaagggttgtacgcatgacactcaatcgcccgatcaccggcagtttgcccagcaacctgaacaccggcgcagttacccgcaacaggaaccccgacacctttgcggcaaacggcgtgtaatacccccaccccagcgccaacagcgccagcagcaccccaccgatataatcgtcctggccccagtgtgcgccggcaaccagtcgcggcgtcatgaacaacagcgccaggccccagatcaccagcacctggctgacgcgcttggcaaacaccgtcatgaacatgccccagatcaacagcaccgaagcgtgatcgccggggaagctctggcttgagcggtccttcaactcccaggttttttccagcccagggaaaaaatcactcatttgaatcgcgccgctgatcaccatcgacgggctgctgtgttgccagtccatgtgggccgcgagcttggagaacagcatgcggataaacagcaacagcagcaggatgccgaggaagccaaaaaacgcctggcgtacctgtacggccttgaacacccaatcgccgcgaatcagcaacgccagcaaaatcacgccgaccaccgcatcaaatggccgcaggctggccacggcccacacatgcagccaggtcgagctggttgccagcgggtcattaagcagatgaaacagccactcgtcgaaaatcacacagagcatctggcccgtgggccacagccaaaaacacagcagcccgatagcgagtagattgcaaagagcccatcgccggaggttccagttggcttggaacaaacccggattgttcataaactgtccctcatcgctctattaagctccttgttttcaggagaagtcgcaccaacatggtgctaaagcgtttaattttataaaccttgtaatcattttgtcatcacttcagatacccagacctatgaccgatctaccggataccgacttcacccaacgctttatcttcgatgagagcgacgcccgcggcgagatggtctcgttggagcgcagctatgccgaagtcctcgctaaacatgcctatccggagccggtcgcgcagttgctcggtgagctgatggccgctgcggcgctgctggttggcacgatgaagttcgacggcttgctgatcttgcaggctcgctccgaagggccgatccccatgctgatgatcgagtgctccagcgagcgcgaaatccgcggcctggcccgatatgaagctgaccagatcgctgcggacgccaccctggccgacctgatgcccaatggcgtactggccctcactgtcgacccgaccgaaggccagcgctaccagggcatcgtcgaccttgatggcaaaaccctgtcggaatgcttcaccaactacttcgtgatgtcccagcaagtgggcaccaagttctggcttaacgcagacggcaagcgctcccgtggcttgctggtgcaacaactgccggccgaccgcatcaaggatgacgatgatcgcgctgaaagctggcggcatatcatcgccctggccgacacgttgaaggccgaagagctgctgggcctggacaacgaaaccatcctgcaccgcctgtaccacgaagaggccgtgcgcctgttcgatgcacaggggctgcgcttcaattgcagttgctcgcgagagcgttcggccaatgccttggtcagcctgggcctggaagatgcgcaaaacctggtggtggaacacggcggccatatcgagatcgactgccagttctgcaacgagcgttatctgttcgatgccgcggatgtagcccaattattcgccggagcaggtatcgacaccccatccgacacccgccactaaaacgtttaagcacaggtaaattacctgtcgaatgccggattagaggcgttctgacgggagggccctactctttttgggcttttctggcataatccggcccacttttttcgcggtagtagtgcgcaactttctactacaaaacgtttggagcactcggccataggccgacggggaacctcatgacgcaagccaataacgccgtatacaccgatctgagtgttgacgatctggtcaaagaagccctgcagcgcggtgaaggcgtgcttgccgatactggcgcactggtcgtagaaaccggtcatcgtaccgggcgttcgccggttgaccgtttcatcgttgaagagccttccacccaggacgccattgcctggggcccgatcaaccgcaagttcccggccgacaagttcgatgccctctgggctcgcgtcgaggcgttcaacaacgcgcaagagcattttgtgtcccacgtgcatgtaggtgcttccgaagaccactacctggccgtgaaaatgaccacccagactgcctggcagaacctgttcggtcgttgcctgttcatcaacccggcccagtacaacccggccggtcgtgaagagtggcaagtgctcaacgtggccaacttcgagtgcgtgccagagcgtgacggcaccaactccgacggttgcgtgatcctcaacttcgcccagaaaaaagtgctgatcgccggcatgcgttacgccggtgaaatgaaaaaggccatgttctcggtgcagaacttcctgctgccggcctccgatgtattgccgatgcactgcgccgccaacattggcgaagcaggcgacgtgaccctgttcttcggcctgtccggcaccggcaagaccaccctgtccgccgacgaaagccgttacctgatcggtgacgacgaacacggttggggcgaaggcgtggtgttcaacatcgaaggcggttgctatgccaagtgcatcgacctgtcggaaaagaacgagccggttatctggaaagccatcaagcacggtgccgtgctggaaaacgtggtgatcgacgatgccaagcacgccgactacgcggacgtcagcctgacccagaacagccgtgccgcctacccgctggagcacgttgccaagcgttccgagaagaacctgggcggcgagccaaacgcagtgatcttcctgacctgcgacctgaccggcgtactgccgccagtgtcgatcctcagcgaagaacaagcggcctaccacttcctgtccggctacaccgcgttggtaggctcgactgaaatgggttccggcagcggtatcaagtcgaccttctccacctgcttcggcgccccgttcttcccacgcccggctggcgaatacgcagagcttttaatcaagcgtatccgtggtttcggctccaaggtctacctggtcaacaccggctggaccggcggcggctacggcgttggcaagcgcttcaacatcccgactactcgcggcgtgatcgccgcgatccagagcggcgcgttgatcggtgcgcaaactgaacacctcgacaccatcaacctcgacgtgccattggccgtaccgggcgttgaaaccggcctgctgaacccacgtaacacctgggctgacaaagccgcctacgacgaagcggcgaaagcgctggctggcctgttcatcgagaacttcaagaagtttgaagtgagcgatgcgatcaaggctgcgggtcctaagttgtaagacttagctgttgtgaaaaagccgcctcctgtaggcggcttttttgtacgcgcagggttaatgggcgatgtgcagcaccaccgcgccgaccagcaccagcacaaccccgagcacctgtaccgccgacaagcgctccttgaaaaatacaaagcccaggatcgccgcaataccgcctgacagtgtactgatcaccgtgaccaccgataccgaccctgccatcgcgccccacgaaaacgccgagaacccgccgaggttcatcaggctggcaccggtcaacgtcgcgcagtttttcagtggtgggatcttcaggccgtccttgatcttcagcaccatcaccaccagcacgcacaggcccaccaggtaccccaaccacaacatggtgatcggccccagtgccggtagtgtgtagcgaccttgcagccagaaactggtgccgtacagcgttgcggcgagtatggcgtaggcgatggacaggcgcgggttgttgtggggcgtgccgttgtccttgtggatgctggacaggaccaccccaagcacgcacagggcgatgcagcccagttgtatcaggctgatgtgttcaccgctggcccaggacagcagggtggtcactacaccataagaagtgaccaatggcgcgacgatggcggctttgcccagggcgaaagccttggacagcgcgagggctccagagacggtcagcagggccgctgcgatgcccaggagccagacgctcaacggcgcatcgagggatttgaaaaggtaggtcgggaatatgaccagcagcaacgtcatgatcagaaagccgagggcttggccgaaatacaccgcgcgtttaacgccaacggcgcgggcattgaggcccacgagaaagtccgtgccaccccagagcagggcggccagcaggcccattagtacgtccatgtaggtccttgttatgcataccgctcgccagattaacgcagaaccaatgtgggagggggcttgctcccgatagcggtgggtcagctatagataagctgactgattcaccgccatcgggagcaagccccctccctcattggtatctcagtgctcttgggatcagctcaggttttccaaggtctgcgtgtcccacctgtgggtcttgatcgccaggtagagcataccgatggtcagcggtattttgtcgccacggcctttggcgcgtcgcttcaagaatacgtcgaacatcggcggctgaaagtaacgataagcgtcgtagtcgcttaggtcgacccccaaaatcctgttccagcgcctccatgaattgcttggcctcaacgccatcgcaagcaaggtcgaagttgagcgaggtttgcaggcgaatggtcttgtgttgcggcagaccgatttcttcatgcagcaattgcaggagctgctgcatgacggggtcttcggggaagtggggggccaggttcatggtagggtgcgtaggagtgggtgagggggctgtcgcgttcaggtggtcagtggcttagaagtgaggttgttctcgagcaataaacagatagtttaatcgttcgcggttcgatcaggtactgggaggcttactgatacaccgctcaaaaatcgcctccaatccccgataatcacacgccaccgcatcaatattcgccggtatccatgccgcgtgtttcaccaaccaccagttcaccgaaaaccccgcattcacgatgatctgttcaaacaggatccgctgagcccgtccattgccttcacggaagggatggatgacattcagatcgccataagcttcagcgatgtggtgaacgagatcggcctgggacgcgccggtataccaattggcttcctgcatgcgttgaatgatttttgcagcttccggcgggatacgctccggcgtgcagaacagtgtgtcacctttctggatgttgacgctgcgcagttcgccagcccagtcataaatgtcaccgaacaggatgcggtgaatgtgttgcagacgttctaggtcgtagggcggcggaaacagcggaagattgcctactgcaatttcggataactcccgctctgcctcgtgcaggcggtgttcatcgagcaaatcgaggcggttgcgcaggacgctgctaccggggtagcagtacgggtcctggcccaccccgtatttgtcgagcatcagcgtgaggtattgcggtatttggccaggacggcttcgcgggtcggcaggggcttgtcgacatcggtcggttgggtatcgaacccttccaggcgcaggctggccaggtaattggaacggcggatcttgtgatagtgatcctgcttttgctcaaacgtcagttcgctcattgcagcgtactcctgggtagcaaggctgtgattgtagcgcaatgcttcagggggaaggcagtataaaaaccaagtcgtaacctgtatcaaaatcccgccgaagatcttaattcaatgtgagttttcgcaatattccccgtcggccctgggccatcccctgcctgtgtatcatcctgtctcttatttccttgcgacctttctcgattcgccgaacttactgggctacgtttttaagccacgttcagcggtcaatggagtgacagccttatgcacgacaccctccagcaggtctttggttatccacagtttcgcctgggccaggaagagacggtcagcgccgtcctggccgggcgttcggcagcagcaattttccctacggggtcgggtaaatctttgtgctaccagctgtcggcggtgttgctgccgcacctgacgctggtggtgtcgcctttactggcgttgatgcaggatcaattggggtttctgcagcgccatggcatttcggcaggaagtatcgattcggcccagagccgtgatgaggccaacgatgtgatggcccgtgcgcgttcgggcgagttgaaaatcctgatgatttcggtggagcgtttgaagaacgagcgctttcgtaacttcctgcacagcgtgcagatttcgctgctggtggtggatgaagcgcactgtatctccgaatggggccataacttccgcccggattacttgaagctgccggactaccagcgccagttcaatatcccacaagcgttgctgctgacggccacggcgacgcccaaggtaatcgccgacatgcaggccaagttcgcgattgcccccggggatgtggtgaccaccggcttctatcggcccaacctcaacctgctggtggaaccggtcagcggtcagcacaagcgccgcaggttggttgaatggatgcaggagcgggccaaccaaccgagcatcgtctatgtcactttgcaaaaaaccgccgagcagattgccgagcatctgaaccgccacggcattcaggccgaggcttaccacgcggggctgccccacgataaacgcgagggcatccagcagcgtttcatgggtgggcgttccaattgcatcgtcgcaaccatcgcgtttggcatgggcatcgataaaagtgatatccgtaatgtggtgcacttcgacctgccaaagtccatcgagaactacagccaggaaatcggccgtgcagggcgcgacgggcaaccatcggattgcctggtgttggccaatcgcgacagcctcaatgtgctggaaaatttcgtctacggcgacacgccggagcaagagggcattggccgtgtcctcgaggagttgcaggccgcacgcagtgaagggcagtgggagttcctgctcaggtcgctgtccgaccacagcaatattcgcgagctgccactcaagacgctgctggtgcagttggaactcaagggtgtgatcgcgccgcgctacgcgttttatgccgaataccgtttcaagtacctgattgagcccgacgctttgctcgcacgtttttccggcgagcggcagcagtttgtcgcggcgatcatccaggtgtgcaagcgtgcgaaaacctgggcaacagtggatttcgacgcgctgtatcaacagcacaatgccgagcgcagtcgggtggtgaaggcgctggattacttccaggaacagggcctgatcgagctggaaagcaagcagatgaccgaggtctacagtttgctcgacaccgattttgatccagtggtgttgagcgccgagttatacacaggctttaagcagcatgaagtgacggaggtggcgcggattcacgccatgctcgacctgttcgccaccgaacactgcctggggcaacgcctggcgcagtacttcggtgatgaaaacgctccccagcgttgtgggcattgttcggtgtgccacggccatgtcgcgtatctgccgcctccgccaagcctgccgccacttgtggataaaagttttatggggctgtgcggcgattttatccacaggcatcatgagcacactggcgagctacccggtgccgagcggctgacgcgatttctcggtggtatcagcgtgccgttgtttaccaagttgaaggcgcggggggttcccggttttgccgcgctggaggactacccctacgccgaagtgcgcgactgggcccacgctcaattaaacctactctgacgagacttgccgatgcctgactcaacgccccagcgcgccgattaccgctacttccagccgatcaccacgcgctggcatgacaacgatgcctacgggcatgtgaacaacgtcacctactacagcttcttcgatacggcggtgaatacctacctgatcgaacagggcggtttggatattcacgacggcgaggtggtggggttcgtggtgagttcggcgtgcgattattttgcgtcgattgcatttcccgagcgcattgaaatcggcctgcgagtgggcaagctgggtaatagttcggtgcagtacgagctggcggtgttcaaggccgacgaagaagaggcctgcgcggcggggcgctttgtgcatgtgtttgtggatcgggcgtcgaaccagcccgtgccgataccggggatcttgcgcgaggcgttgcagcgactggcggtttgaccttgcggcacccgatgtgggaggggcttgctcctcccacattagtactgcggtgctcttcagagcttaccgatgacggtagtgatgcttgttcttgcgatgcccgtaggcatggccgcggcctggatggccatcgcggtagtaacgacggtcgtcacggtcgcgatcgcgataacggcggtcgtcacgatcactgtcgttacccatgtagttgcccaatgcgccacctgcaccaccgccggccgctgagccgatcagtgcgccggtgctgccgccgacactgcggcccacgacgttgccaccggctgcgcccaatgcgccgccaatggcggcttcgcctcggctacgcttatcggcaccgactgcactgccgcccgcgccgcccagggctgcgccaatggtcgagccggtgttgccgcccaactgttggccgacaacagaacctagaaccccgcccaatgcgccgcctacaccggcttcggtggtgccaccggccatggctgcgccactgaccaggccaagggacaacaagagaatcgaggagaacttcattcagggaaacctcaaggggatgacggcgcgatcctgaggttgtatcgagacgctgacaatcgaaatccgaccggcggcagaggttgtatacaatttgctaagttactgttttttatcgggaacttaagttgtttttacaggtctttagttacttcgggacggccgcttttatgcaaaagcggccttttttgtgcccgcagaatctgtcgtgactgcgctggcctcaagtcccccctcccatatttgaaatgcattccaagtgtgggagggggcttgcccgcgacagcggtggttcaagcaacgaatagttcggatcaagtcaggccgagcgtgccatgatcagcccgctgtcacttgcggcttctagacggatcgcgacgaacttcgacgtcggcgtgtggctaccctcgccagtgctttccaacggcaccagtggattcacctccggatagtacgccgctgcctgccccgccggaatatcaaacgccagcaaggtaaagcccttcacacggcgctcacggccatcctcccacaacgacacgatgtcagccttctgccctggcttgaagcccaggcggatgatgtcggcttcgttgacgaacagcacgtcacgctggcccttgaccccgcggtaacgatcgtccaggccatagatggtggtgttgtactgatcgtgggagcgcatcgactgcatgatcaggtccggcacccggcccgtggcatgggtgcgttcgtggatcaggtccttgggcaggatgttcgggcggaagttggcgcggcccgatggtgtgttccagcggcgtgcaccggccgagttgccaaggtagaacccccctgggtgcttgatgcgctcgttgaagtccttgaagcccgggatggtgtcggcaatcaggtcgcgaatgcgcccgtaatcggccaccagccagttccagtcaaccggtttgctacccagggtggcggcggcaatcccggccaggatcgccggttcggacttcatctgcgccgacagcggttgcagttggccgttggagccatggaccatgctgaacgagtcctccaccgtcaccgcttgcgggccgtcggcctggatgtcgatatcggtacgtcccaggcacggcaggatcagcgcgtctttaccgtgcatcaggtggctgcggttgagcttggtactgatctgtacggtcaggtcgcaattgcgcaatgcttcgaaggtgcgcaggctgtctggcgtggcttgggcaaagttgccgcccaggccgataaacactttggagcggccttcgagcatggcgtgaatcgcttccaccacgttgtggccgctgtcgcgtggcacctggaactggaagcgacgctccagcgcgtcaaggaaggctaccggtggacgttcgttgatgcccatggtgcgatcgccctgcacgttgctatggccccgcacagggcacaggccagcgcctgggcggccgatattgccgcgcaacagcatcaggttggcgatttcctggatggtcggtaccgaatggcggtgctgggtgatacccatcgcccagcacatgatcacgttcttgccttttgcgtacatgcgcgccgcttgctcgatctcaaccagcgtcaggccggattgctcgacgatttcttcccatgaggtgtcgtcaatctggcccaggtactccagtacgttggtggtgtgctcgttgaggaaatcatggtcgaacaccgcttccgtgccttcggccagggcctggcgttcccacagcagcagaaacttggccatgccacgcaggatggccatgtcgccgcccaacgcggggcggaagtaggcggtattggttggcttgtcaccgttggtgagcatttccagcggatgttgcggatgctggaagcgttccagaccgcgctctttcagtgggttgatacacaccacctgggcgccgcgtttcaccgcttcgcgtagcggttcaagcatgcgcgggtggttggtgccggggttctggccccagacgaaaatagcgtcggcatgttcgaagtcgtcaaaggtcacggtgcctttgcccacgcccacactctgggccagggctacaccgctggcttcgtggcacatgttcgagcagtccgggaaattgttggtgccgtaggcgcgtacaaacaactggtacaggtaggcggcttcgttgctggcacggcccgaagtatagaactcggccatgttcgggctgggcagtgcgttgaggtgcttgccgatcaggtcgaaggccgcttcccaactgatgggcatgtagcggtcggtcgcggtgtcgtagcgcatcggctcggtcaggcggccctggtattccagccagtaatcgctttgctccagcaatgcggtgacgctgtgcttggcgaagaacgccgcatcgacgcggcgcttggtggcttcccagttgaccgcctttgcgccgttttcgcagaacttgaccatgccgctttccggcgagtcgccccaggcgcagcccgggcaatcgaaaccgccgttctggttggtcttgagcatcatgcggatgtttttcagcgcattgtcgctggtcaaccaggcttgcgccacgctgatcagtgcgccccagccgccggccgggcctttatagggcttgtagcgtggggttggggtctggtcggcttggtggtgaaggctcatggctgctgctccatcgctgggctatagacccgtggcgcgcttttctgtggcaagtggatgagattgaggttgtgccgacgcgcccattgcaaggccaggccggtgggtgacgacaggctgaccagggtctggatgcccgcgcgcaggactttctggatcaattcgaggctgcagcgactggtgacaatcgccagaccgccgttggtcgggatatttgcgcggatcaaggcgccgatcaatttatccagggcgttatgccggccgatgtcctcgcgacccagcagcaattcgccctgattgttcatgaacaccgccgcatgcactgcgccgctgtactggcccagtggctggaatgcactgatgcgctggcgcaggccatcgagccattcggtgggcggcaagggcgcgccgggcagcacttgcaggtctggcagtgcctgttcaaccgcttctactccgcacaggccgcaaccgctggtgcccgccaattggcggcgctgctgcttgaggttccagaatgcacggctggaaatctgcacctgagcatattgggcagagccggagccgctgattttcagatcatagatgtcgctgacgtcggtgataatgccgctgccgaggctgaagccgacaatgaagtcttccaggtctgtgggcgtcaccagcatcaccgcctggctgatatcgttataggcaatcgccaacgccacctcttcggccagcgcagtactggcgacttcagtgtgtccaagattgcagtattgataactctggctggcgacgggcgcggtcgtttcgagtgcgggcgccgcgcagtttgggcgcttggcgttcatggggcagtaccaccggcggattgatcagtgtttagactaggcgcgacaaagggtcgcgtctaattgccagtattgatctgttgatagatggcgtcgatcacggctgatttgccgcttcactgcgggcttattccaagggcggatgatttcagcacttttgagtctttggtcggtctggaacccaagtctgtaggactggtctagtcttgggcatctggaaattaaatcccaaggagagcgcaccatgagtattttcagttttatcaaagaagccggcgaaaagattgtcgacctgttgacgccgggtaatgcgaatgcgagcgagcagttgaaggagcatgtgagcaaggtgggcctgggtaatccaaacgtgcagaccacggtggatggcgacaaggtcacggtaactggtgaagttgccacgcaggaagagaaagagaagattctgttggcgttgggcaacattgctggggtggcgagcgtggatgatcagatcactgtatcgggccctgcggttgccgctgctcgtttcgtcgtggtgaaaaagggcgacaccctcagcgcgatttccctggcggtttacggtaacgccaaccagtacaacaagatcttcgaggccaacaaaccactgttgtcgcacccggacaagatctacccaggccagacactgcgtatccctgaataatacgcaggacaaaatgtaggagggggcttgctcccgatagcggtgtgtcagccaagtatcaggtgactgaacactgctatcgggagcaagccccctcccacatgggtttagagtccggcaatgagatcgcggtaaccttctactgctgcaaactctgccgtgtcctttggccctttcttgctatcgggctctttcaccgccagcagatgccccacgccgaaatcgcgggcgctgcgcaggatcggcaaggtgtcatcgataaacaggctacgggccggatcgaaacggatgtcggcttgcaaggctgcccagaattgcgggttttccttggggaaaccgtagtcatgggagctgatcaaccgctcgaaatacggcgccagttcaatgcgttccaacttcaatgacagcgaatcacgatgagcattggtgatcaggatcacgcgcttgccggcctgcttgatcgccgcgaggaacgtatcggcatccgggcgcagggcgatcaggtgggcggtttccagcttgagttcgcgcaccgggatcgccagctcagtgctccagaaatccaggcagtaccattgcaactgtccggcgttacgctcgaacagcggctgcaactccatctcggccatggcgcggctcacaccgtgcagttcggcgtaacgctggggcaggtgctccatccaaaagtggttgtcgtaatgcaggtcgagcaaagtgccgtccatgtccagcaggacggtgtcgatggcgtgccagggcaaagagggcatggtgcgttctcatgtaagtaaagatatccgacacagacaatcggaaaagccacggtatagtaacccgatcacgccaaggagccgcttatgcgccagaagcccaccgtcctcgcccgcgaaatagtcgccagtagccgtttgttccgcgtggaggaagtgcaattgcgcttttccaatggcgttgaacggacctacgagcgtctggtggggcgcggcacgggctacggggcggtgatgatcgtggcgatgatcgacgaggaccatgcgctgctggtggaagagtactgcggtggcactgacgagtatgagttgtccttgcccaaaggtttgatcgagccgggcgaggatgtgctggcggcggcggatcgcgaactcaaggaagaagccggctacggcgcacggcagttggaacacatcaccgaactgtcgttgtcgcctggttatatgagccagaaaatccaggtggtgctggccaccgatctgtacgaagaacgccttgaaggcgatgagcctgaaccgatgcgcgtggagcgggtcaacctgcgtgagttgtcggcgcttgcgcaaaacgagcaattcagcgaaggccgcgccctggccgcgctttacttggtaagagacctgttgatccagcgtggagcgttcaacgcatgagcgaactgtttttaggccacccatttatcgcccctgtcattgaactggcgcgtcaggccggtgaagccatcctgccgtactggcgcgccgatgtcgccgtgacttcaaaagcggatgattcgccggtaacggctgccgatctggccgcccatcatctgattctcgctggccttactgctctggatccgagcattccggtactgtccgaagaggatgccaatatcgatcaaagcgtgcgagccggctggcagcgttggtggttggtggatccgctggatggcaccaaggaattcatttctggcagcgaagagttcaccgtcaatattgccctgatcgaacagggtcgcgtggtattcggcgtggtatcaatgcctaccactggccgttgctatttcggcggcgcgggccttggggcttggcgttcggatgtaaatgccgcgcccaagcagattcaagtacgccagaccccggctgcgggcgaagcgtttaccgtggtggccagccgtcgccataccagcgccgagcaagagcgcctgctggatggtttgagcgaaggtttgggcgagctgaaactggcgaatatcggcagctcgttgaagttctgcctgttggccgaaggcagcgccgattgctatccacgcctggcgccgacgtcacagtgggatactgcggcggcccagggggtgctggaaggggcagggggcgaggtgttggagttgaatgggcaaccgttcagctacccggcacgggaatcgttgttaaacccattctttttggcgctgcccgcgaaggctgcatggcgcgaacgcctattgaccctggccagatcttaagatcacaacagggcaaagtgtgggagggggcttgctcccgatggcgatgattcagtcactagatacttggctgatacaccgctatcgggagcaagccccctcccacactttttagcggtgcaggacgtactggccggtaaaggttactgccctctctgcgctgcctgcattcacaatccatgtctccagcgccaaccgcgcccgcccataacgcttgtacgtcgccaaaaaacgcttccacaccttctcttccggcgctgcgcaaatggctgtcgcatcctgcgtcaccggcaacggataactgatctgcccttcctgaatcacgatatgcccgtcttcaatcccttcttcgcgcaatttcaggtgcagccaaccccaacccgcgagcacggcgccgcaataaaggctgccgccaaacatggtgctcttatggttgatgttggcttgcaaaggtaaatgcagatgcagttggtcgtgctgccagtcgagcaccttcagacccatctcccgggtgagggggatatcgtggtgcaaaatggattccagataacggctgtcgcgactcatgtaggcctcttggcaggttgcggttgtcactcgtcgtcagcgccgtggttggcgctgtcggcgaagttcaggccgtgcttgcgcagtttgtcgtgcaacgtcttgcgtggcacgcccagggcttctgcgaggctgcgcagggaactgtgggggcgggtcagttcggcggcgatcaggctcttctcgaactgctcgacctgctcgctcaggccgccaggggtggaggtcagcacgccggctgccgggttgtcctgggtgttgtccagcgccaactccaggcccagggcgaaacgctccgcagcgttttgcagttcgcgcacattgcccggccagctgtggcgcagcaatagcgcgcgctggcccggttgcagctcatgcaggggcaggccatgacggctgctggcctcgtcggcgaagtgctggaacaacatcagcgcatcttcgccacgctcgcgcaaaggcggaatgcgcagcggcgcgacattcaggcggtaatacaagtcggctcggaagcggccctggtcggctgcctggcgcaggtcttccttggtagcggcgataatgcggatatccagcgggatcaactgattgccccccaggcgctccaccacgcgctcctgcaacaggcgcagcaacttgacctgtacatccaggctcatgctttcgatttcatcgaggaacagcgtgccgccattggcgaattcaaacttgccgatgcgacgtttctgcgcaccggtaaacgcccccggctcatggccgaacagttcgctttccaccaccgactcggccagcgccccggcgttgatcgccacaaacgggccgctgcggcggttcgacaggtcatgcagcgcacgggcgacgacttctttccccgccccggtttcgcccaggatcagcacatcggccttggtcgcggccagcgccccaatttgctcgcgcaggcgcaacatttgcggcgaatgccccaccaggcgtgtgctcagttgctggcgatcactgagggccaggcgcaggctgcggttgtccagcaccaggcggcgcagggccagggcgcggcgcacgctgtcgagcagggcgtcgctggcgaagggtttttccaggaagtcataagcgccggcccgcatggcttgcaccgccagcggcacgtcgccatggccggtgatcagcagcaccggcaggtccgggtcctgaccgtgcagttcggccagcagttccaggccatccatgccaggcatgcggatatcgctgactaccacccccggccagtcccgcgacaagcgtgcggtgaggccgctggcttcgcccaggggcaggactttcagcccggccaggtccagggtctggcacaaggcctgacgcaggtggggatcgtcgtcgatcaacaccacctgaatctggttatcgatactcatacactgcggtcctcggacggttgcagactgacgcccggcgagccggcacgcaatttcaaggttaacagcgcgccgccttccttgtggttggcgaacagcagttcgccgccaaaggcacgcatcagggtgtcgcagatcgccaggcccaagcccaggccctgggtgcgcgtcttggtggtgtagaacggctcgctggcgcggcccagggcttccatgcaaaagcccgggccattgtcgcgaatgtacaggttgacgccctgcgcagtggtttcggcactcagccagagtttgcgcggcgggcctttttcggtgagggcgtcgagggcattggccaacaggttgcccagcacttggcgcaggcgggtttcaccggcctgcacccacagggttgcctccggcaggtcgcggatcagctccacttccatcgagcgccgccgtttggccagcaacgccagggcgtcgtccagcgccggttgcagggccacgctctccggtgcatggcggtcgcgacgggcgaaggcgcgcaggtgggcgatgatcgaggccatgcgcccggtcaattcgctgatcagcttgaggttgccgcgggcatcgttggtgcgctcgtggtcgagcaggatttcggcgttttcggcatagctgcgaatcgctgccagcggttgattcagttcatggctgatgctcgctgacatggtccccagtgccgaaagtttgccggcctgcaccaggtcatcctgggcgcgcaccagttcctgctgggcgtgctcacgctcgagcacttcctgtttcaggcgccggttcaggccctccaggtcgctggtacgctcggccacgcgcatttccaactcgcggcgagccttggcttcgaaggcgatgcgttccaggtaatgccggcggcgctgcatgatcaagcccagcaacagcatcagcaccaacagcgtggcaccgccgacggccatcactgtgcgcaccgggcggttgatcagcgagcgtggtgcgaggatttccacgttccagccggtctcggcgatggccgtggattggcgcagccaggcgctgctgctcaggctcagcggttgtgggtcgcgggtcgggtagggctggatggcaatgatggcctggcgttcttcggtggtcagtggccgcgtggcgcggaaccgccattgcgggcgtgaggtgaggatcaccacgccgttgtggtcggtgaccagcagttgttccggggtattaccccacaggctttcggtgtggtccaggtcgaccttcaccaccagcacaccgatgatcgtgtcgccatcacgtaccgctgcggcaaaaaagtagccgcgcttggccgaggtggtgcccaggccgaaaaatcgccccaggcgcccggccatggcctcgctgaaataggggcgaaaggaaaaattgcgcccgacaaaactgtcttgtttgtcccagttggacgcggccagggtcttgccggtggtgtccatcaaatacatcacttccaccccggcctgggcggcgacgtccttgagcagcaggttggcgttgaccaggttggtgctgacctggggcgcgtccagcgcggtgcgcagggccggcaggtcgccgaggatctgcggcagcacttcgtagcggtgcagggtgcccagcaggttggcgacgtagaggtcgagggtctgacgattctgcccggccagttcgctgcggtaatagcgctcggccaggtgctccagtggccacaacagcggtgccaggcataatgccagcagggcaaggctgcgccagcggggtcgtcgcgcaaggggtggagtcatggggatcgcgcctgtgggtacaggcgcattatgcctagtgctgctgtgcaagacactcttgcaatgcgtcctgccactgcggctggctgacctgccattgctgctgcagccgcttgcagtccaggcgcgagttcagcgggcgcttggcgggcgtcgggtaggcgctggaagggatcggctccagttcggcgcaggctttcccgtcggcccgcagctgcgcgccaatggcctcggcgaagccgaaccacgaggtttcgccttgggcggtcaggtgatagacaccccattcaccggccttgccggcttgccactgctcaatcagcaaacgtgtgctgttggcgatggtccccgcccaggtcggcgcaccgatctggtcggccacgatgcgcatctgcgttttttcctgcagcaggcgttgcatggtcagcaggaagttcttgccgtggctggaatacacccagctggtgcgcagaatcaggtattggccacccacggcagcaatcgcctgctcgcctgccagcttgctctggccgtagacacccaatgggtttggcgtgtcgttttcggtgtacggggcaggtttgctgccgtcgaacacgtagtcggttgagtagtggatcagcgggatgcccaatgccttggcttcctcggcgaggatgccgggggcgacagcgttgatggcaaaggctgcgtccggttcgctctcggccagatcgacggcggtgtgggcggccgcgttgatgatcaggccggggcgatgggcgcgtacctgttggcggatcaggtcggcgttggccaggtcaagctggtcgcggcccaggacgatgagctcgcccaggccctggagccgctgttgcagctcttgggagacttggccgtgttggccggtgatgaggattttcagggaagtcgtcacaggaataagtccgcgtctttcaggtttgcaccgttttgatccttggcggacagcgtcggcgtgccgttgagctgccaatcgatgttgagatccgcgtcgttccaacgaatgcaacgctccgcagagggcgtgtagtaatccgtggtcttgtagaggaattcggcgtaatcgctcagcaccacgaaaccgtgggcaaaacccggtgggatccacaactggcgattattttcggcagacagtcgcacgctggtccatttgccgaagtgcggggagctgcggcggatatccaccgccacgtccaggacttcgccagccgtcacacgcaccagttttccctgggcgtgttctacctgatagtgcaggcccctgagcacgcccttttgcgagcgtgagtggttgtcctgcacaaattgcagttgcagcccgctggctttttcaaactcacgagcattgaaactctcatagaaaaagccgcgctcatcgccaaataccttgggttggatgatcaatacaccgggcaactcagtggcggttacattcatttagtgttcccggcgagcatgtacaagtactggccatagccggttttgccgaagtatttggcgcgctccagcagatagtcacggtcgatccagccgttctcgtaggcgatctcttccaggcaggctactttcaagccttggcggtgttcgatggtctgtacgtaggtagaggcttccaacagactgtcgtgggtgccggtatccagccaggcgaacccgcggccgaatcgctctacgtgcagatcaccgcgctggaggtaggcattgttgatgtcagtgatttccagctcgccgcgtggcgatggcttgaccgccttggcgatcttgatcacgtcgttgtcgtagaaatacaggccagtcacggcgtagtgggactttggcttcaacggtttttcttcgatggacagggcacggccttcttggtcgaagtcgattacaccgaaacgctctgggtctttgacccagtaaccgaagacggtagcgcccgaagggcgtccggctgcgccgcgcaattgatcgctgaaatgctgaccatggaagatgttatcccccaggatcaagcacaccggatcattaccaatgaattcttcaccgatgataaacgcctgggcgaggccatccggcgaaggctgctccgcatagctgaagcgcacaccgaactggctgccgtcgcccagcaggttacggtactgcggcagatccaccggggtagagatcaccaggatgtccttgatccccgccagcatcagcactgagatcgggtagtagatcattggcttgtcatacaccggcaacagctgcttggacacgcccagggtaatggggtgcaaacgggtgccggaaccgccggccaatacaatgcccttcatcatgcgatcaaatcctttgcgtcagtgttgcccaatcgttcaccttgataactgccatcctggaccctgcggcaccattccaggttatcgaggtaccactgcacggtcttgcgcaggccggtctcaaaggtttcttccggaacccagcccagttcacgctcgatcttgctggcatcgatggcgtagcgttggtcgtggcccgggcgatccttgacgaaggtgatcaggtcggtgaatttctccacgccggctgggcgttgtggcgccagctcttccaacagggcgcagatgccacgtaccacgtcgatgttcttctgttcgttatggccgccgatgttgtaggtctcgcccacaaccccagtggttaccactttaagcagcgcgcgggcatggtcctcgacgaacagccagtcacgcacctgcaagccatcgccatacaccggcagcggcttgcccgcgagggcgttgaggattaccagtgggatcaacttttcggggaagtggaacggcccgtagttgttcgagcagttggtcagcagcaccggcaggccataggtgcgctgccaggcgcgtaccaggtggtctgaggccgccttgctcgcggaatacggcgagctgggggcgtaaggcgtggtctcggtgaagagatcgtccacgccgtgcaggtcgccgtagacctcgtcagtggagatgtggtggaaacgaaacgcgctcttcgccggttctgccagcttctgccagtaggcccgggtggcctccaacaggctataggtgccaacgatattggtctggataaaatccgacgggccgtcaatggaacggtcgacgtgggattcagccgccaaatgcatgatggcgtcaggctggaagcgcgcaagtatggcgctcacggtggcctggtcgatgatatcggcctggacgaactcatagcggctgttggacgcgatactggccagcgactcgaggttgccggcgtaagtcagcttgtccaggttgagcacttcatgctcagtgtgttgaatcaagtgccggatcagggccgagccaataaatccggcgccgccggtgatgagaatgcgcatgtcgagggccttttccttagacggacattgggcgaaagaagcatagcttgagttgtgaatcgggccggcgcaagcgccgcgagcataaggggttgattaaagcccctgaacaatggcgatatagacgtctgaaaaaacaaacgccgtcacaatgttgttgcccctgttgacccatcgtgcctgttcaagcggcactatggacagcacgcatggcggctttgttctgtaaatctgccgtgatgaccacgccacaatcgcttttcgatagttatcgactacttcatgtatttatgaatgttaatccagattaaccgcttttaaagccgatttttatccgttataaagtcgaacttcaccccattcggagccctgatcgccatgaccaccctgcacagcacccctcgcgccgatggcttccacatgcctgccgaatgggcgccacagacccaaacctggatgatctggcctgagcgccctgacaactggcgcctgggcggcaagcccgcgcaggcagcccatgtggccgtggccaaggccattgcccgctttgaaccggtgaccgttgcagtttccgccggccagtacgagaacgcccgtgcgcgcctggatgtgcccaatatccgcttggtggagatgtccagtgacgatgcctgggtgcgggataccggcccgacattcgtgatcaacgacagtggcgaagtacgtggcgtgaactgggatttcaacgcctggggtggtttcgacggcggcctgtattcgccgtggaaccgtgattcccaagtgggtggcaagatcctcgagatcgaacgtgcgccgcgctaccgtactgaaggctttgtgcttgaaggcggttcgatccatgtggacggcgagggcaccctgatcaccaccgaagaatgcctgttaaaccgcaatcgcaacccgcaccttgatcgagcagcgatcgaagcagtgctcagcgatcacctggcggtggataagatcatctggctgccggacggcctgttcaacgatgaaaccgacggccatgtggataacttctgttgctatgtgcgcccgggtgaagtgttgctggcctggaccgatgacccacaagatccgaactacgcacgctgccatgcggccatggatgtgctgcaaaacagcaccgatgcccaaggccgctcgttcatcgtgcataaaatgccgatcccggggccgctgtacgccactgaggaggagtgcgccggtgtcgacccggtggacggcagccaggaacgtaacccgaccgtgcggttggccggttcctacgtgaacttcctgatcgtcaacggcggcatcatcgcgccgagtttcgacgacccgctggacagccaagccaagcagatcctgcagaacctgttcccccagcacgaggtggtgatggtgccggggcgtgaactgttactgggaggcggcaatatccattgcctgactcaacaacagccagccccgcagagaaattgagtgcagttgtaacaacgccttgatggcaagcgggggcacggtgcgattgcagtgttcccggtaagcccgcggcccaggcaggttgcgggcttttttatacctgaatgccaatgaacactgggaattggcatagctcttgtatcgctgtcgtaacagtggcccagggtgatgactgcacagttctgtcacaaaccttgagtaagttagccgctcacgcagcaggagagagcgctgaaatgaatgccgatatcaaccctatctacacgcgcccgttccacccgacgcgggttaacggcgacgcgatccatgcgctggcgctctggttgaaggcaaacggctcgcgacagatcaggcaagcgcctgactggcgcagcgtgatgcgtgaacgctacccggcggggttgttcacggaggatgaagtgcgcgagctgtgtgacctgatgtgtaactctaaggcgcgctgagaccttatgtgggagggagcaagcccctcccacaggtttcatttattcggccttagaaactgtaggtaccggtgacgaccaggctacgcggctctcccggctgaatctgcgccgcgctggtcgccgaggcatagtagttcttgtcggcgatattgttcagtgccgccctgacgtcccattccttctgacggaacccggccagtgcgtcccagcggccatagcccggcagcaccacagtgttgaggttgtcggcgtaacgatcgcccaccagggtcaagccggtttccgcgtaccaacccatttgcggcttccaggtgatgaacaggctggcattacgcttggctacatcgctgatccgtttgccttcaaagccgttgttgtccttctccaccttggcgtcctgcagccccacgccgccgcgtacgtaccaattgtcgacgatcttgccggtggcggtcagctccacgccgcgtgagcgttgcaagcctgtgagcagggtaatggtgcggtccagcgggtcgctggtgcggcggttgtagagttccagttcgtacacggccagggtggtgctcaggcggtcgtcgagccagtcgcttttcacgccgatttctttttgcttggtcagctcggggctcaggtcattggcgccgcctgccgcattcggcgtgataccgatcagaccgccgcctgcgggtgtgaaggtcttgctccacgaggcatagaacgaatggtgctccagcggcgtccacaccaggccgacgcgtgggctggtgctgtggctcttcacgttttgctgggtgttgagcaacttgctggtggtgtccacttcaaagcggtcgtaacgcagcccgcccaggagctgccactggtcattcagacgcagttggtcctgaacgtacagggcgcgactttcgacttcggtgtggttgttgctcgaaacgctcatgcgcccggtgtggctcaggtggcgattgggctggttgaggttcaggctcggcacggcctggccgcctcgattgacggcggtagcggagtacagcttcggatcgcggcgctggctgcccagctcaataccggtgagcaggcggtgctccaggccgaaggtgtcgaaaccaccttccagctcaaggttgttgaacacattgcgggtggtcaggtcctgctgccagcgctgtcggctgacggtgttggttttcgggtcgtagccggtctggtaggtgttgtcgaaatcgctgtcgagcttgaacacgccgagggtgtggcgcagttgccagttggcgttgagctcataggcgagcttggaacgcagggactgggatgtatcgtcgatgtaatcgccgctatcaaaataggtggtgctgcggctcacatcggccggacgcccgttgaccccggggatgccgcggtccggcgtgcggttgtagcggctgtattcgtattgcaccagccagttcagctcaggggtgagctgccagctcatcgatggtgcgaacaactggcggttgccactgaccccatcgcgaaagctgttgttgtcctggttgcccatgttcaggcgcaggctgatggtgtcagtcggatcggtgctcaggtcggcatacaggctgcgcaaatcattgctgccgccttgggcttcgatgctggatttctgcccctgggtaggcagtttgctgacgcggttgacgatcccaccctggcctccgcgcccgtacagcaccgcagccgggcccttgagcacttcgatgcgctcgatgttatgcaggtcgcgcacgtactggctgtcgtcgcggatgccgtccagatagaaatcgttgctcgcgtcaaaaccgcgtatgcgcaaactgtcgaagcgcgtgtcggcgccgctgctgacgttagggatgccgcttaatgcctggcccaggtcgttggtgccgtaggagcgcaggctttcggtcttcacggaatcgatggcctggggcacgtagcgcacggacgtggcggtgcgagtggcggtgctggtttccttgacgcgtgggtcatcttcgtcagcctcggcgttaatcgaggtttcaggcaataccgtggtcgcattggcaaaaccgacagacagcaaaaaagagagccctaaggaaatgggcgtcaggcgcgggacaagcatgggggggagtatccaaatggtctggcagggaaatagtgcgcgaatggtaatgctttgcatttgcgcgtgttatctattccctatggtgctgcctgttagatttgttacttaatgtgtttttgtccgtgtgcagccacatttggtgacgttcattgcagcgctttagctcgctgcttagacgaatatcgcctaaatacagacgattcacgaaattgacacttagttcaatgcccgcataggattgcgcccaacgcctgtggctaaccaccatgactaaatccaataaaaaaggcctgcggcagttcagtcgtccgcgggccttctttttgcggaaaaaagtcgacaccagaaaaaagcaacacggagcctggtgtcacagcgcgtactcaacccgtaataaggaatataagaacatgttgaagcaacggatgagtctgatcgctctggggattttgagcgcatcgacagcaatggcaaacgaccaggagcaatccaagggttttgttgaagacagccacctgaacatcgccgcacgtaacgcctacatcagccgtgacaaaaaaaatggcgagaaggacaaagctgaatggggccaaggcttcatcggcaagttcgagtccggcttcacccaaggcaccgtcggtgtgggtgtggatgtgattggtcaatacgctattcgtctggatggtggtaaaggtcgcgctggcgccggcggtatcgacttcttcaagcagggcaacggcactgttgatgaaaacggccagcggaatcctggctcggcaccacacgacctggccaaaggtggcgcagccgtgaagtttcgcgtttccaacaccgtactcaagtacggcgaccagttcccggctgtacctgtgctgcagtacgacaactcccgcctgttgtcggaaacctacaccggtacgtcgatcgtctccaaagagatcgccggtctgcaactggacgcgggtcacttcaccaaagaagcgcgcaagagcatggaaggcaccgacagcggccgcctgaaaagcatcgactacattggtggtagctacaaatttaccgaaagcctgtcggctgccctgtacgcctccgacatgcaggacgtgctgaagaagcaatacgtcaacgtcaactacgtgctggccctgccagagaagcagtcgctgacgtttgacttcaacggctacaaaaccaagctcgaccgcagcttcgccctggaaaaccaaggtgatgcagacgctcgcgacaacaagatctggagcctgggcgccacgtgggctgttggcccgcacagcttcaccatcgctcaccagcgcagcaccggtgacaccggttacctgtacggtggctaccgcaatgctggcggcatcggcgacggcggcaataccatcttgctggccaactcctactggtctgacttcaacggcaaggacgagcgctcctggcaagcaggttacggcatcgacttcgccactttcggcgtaccgggcctgacctacaacatcgcctatgtgcgtggtaccaacatcgacgacggcagcggccgtggcgatggcaccgagcgtgaaatcttcaaccagttcaaatacgttgttcaaagcggcccagctaaagacctgagcctgcgtgctcgcgcctcgtggttgcgcgtttccgacaacgccagcaagtacaacactggcggtaacgaaatccgtctgttcgccgactacccgatcaacgttttctaattgatcgagcgtcgcgtctgattccaggcaataaaaaaccccgactggttcggggttttttattgcctggcgccgagttgtttcgcctgtagggtgtgtcctgaatgtcaggccttgaccggcgcaagcttcttgcagttttccttgcgcgcggggtattgctcgcatttgcgcagcacggtttgtacctgctgcgtattctgcaactgctggttggccagcagcttttcggtgataaacagttcttccgagcccagattacgttcggccttgtcgatcatcgccagtgccgcttgcccatcaccccgcttgaggtggtagctgatcatcaagtcataggtagaagggccagccagggaccagtccttgatcgcctgcaactctttcagcgcttcgctgtttttaccctgggccaggcgcacggtataggcggtgcgccgaatgctcggctgatccttgaccggcgaagccagtgccttgcggataaacctttcggcatccggcactttgtttttctccagggcatcgatagcaaaatacgcatctttataaccctgcaaggccttcgccacttggggcgtgtttttcatcttcgaccagctttgcgggttgacccgggcgcggcgttcctggcgatattcgcgttgcaagtactggcgcagctcggtgtcgcggtccatggccgacatatgcgagcggttgaagtactgggtggttgcggtgatgccggtggtcaggccgtccttgaccagcacgtccagctctttggtgaactggttgagattgaactgctgcagcgaatcctgcatggcattcttgcgtgctgtgagaaagcccgtgagcaatggcttctgcttgccctggaagtcattgaggcgctccaggctatgggtggcggcacgcggggcgtaaccggcgcggatcatcaagtcggtgcccagcaagtcggcctggtcttcctggctgcggccccaggcggtgctccatacctggtcggaaaaggtattggccagtgcggtgtacagcactgtgttaccgatggttttctgggtgccggccgggtctttgctgaacagcttcatcgtcccggagctgcggtcgacgcccgtatcggcagccatggtggccaaggcgaccgtggaggcgacggtggtgaacatgtctttctgctgctggaaggcagccatgcggtcatggtgatgtaacagcacgtggctcatttcatggccaagcatcgccgcgatttcgtcttcgctggcgacgttgtccagcatacccagcggcacgaacaggttgccgtaagggtctgccgatggcccgaaaccataactgtcggtgatctttacctgcagcggcggcaactcccccggccagcccttggacaagcgcgtgacaatgccctgcaagtaggcttgcagcatcgggatatccaccaggttctgctgacgcgcctcggcagccggtaccgcccgcccgtcgtagctcaggcgctgctggctctggcgctgtgggtcgagcttgtagtactggcgcacgtcggtgttgtccacatagtggccctggacccgggattgggtcgaaggccccaccaggttcagaaacgcctggtctgcgcccttcaacgtcgcgcaaccactgagcaccgaacaggccaacaggctggctgccactagatatcccttcaccgcaacgctccttttattgattgcaaccggcaccaaagccgatggtggaattattgcggctgtccttggcctggcttttggtcaggccctggcaaggcaggtcgacgacgttcagcggcggttcgatgcgcaggtccatggtgtccagccagaccttctggcctgccagctctatctgcaccaggtccagcgcctggttgtactgcaacaccggcacgggctgggtgggcgcatcctttttcgccagctcacgctgttgcttgccctgttcatcgagcaccgtcaccgggtcggccaggaacgcctggatattgtgggtttgcgcccaggcgcctggggtgaagagggcggcgagcaagacaatcagacttctgttcatccttgggttccttgagtcaaagggcaaagcggcgcactcagcgatcgcggtcgaagaaggcttcgatccgctcgctgaacagcaccaacgacagcaatacaatgcccagcacgttgaccggggtgatgtcattgaggctcagcaacacactgaccgccgccaacatcgacatcaccaacagccacgatgggcacggcgaggtaaaaaaccagatttcctggcgccgccaacggctccaggtgcgatggcccgacaggcgccgtgcgtgcagcgccttgagcacggcaatcaacgccagcagcccgagctccagcaggtccagccaattgaagggcagggcggggaagttggctggttcatggtcgtagtccatgcctgagttgatcaggttatccagggccatggcatgcaggtaaacgccggggagctggccgtgtaccggtgactccaccagatcccccgtggacgcgatattggcgcccaccagcaccaagcggtcgcgcagcaactctgcgatcagtgcctgatcgtcggggtcgctgacctccaggtcactggccgacaacgtcagcgtataagggcaccgcgcctgggccgagtcatcgagcttccagaacacggcctggaacaactgcgccaccccgtccagcaagaaatgccgcgccgctgcgcagtggcggatatcagcaatacgcgcctgttcaggcgccagcttcagcccccattgcaccgcgatgggctggcgctgcgcagcggtttgcgcatccaccggcggcggcttgcactcgtgcatggcacagaactcccggtacagcgccaaagcgggggtttccatcagcccggcctgggtttgcttggccaatggatacttgtcatccaccccttcccacaccacaagggctgggcggctgacctgcataaaaggcgccagcgtattggcctggcccgcctccccgcgcgccaaaccggtattggccaaccacagcgggatgccctggcgttgataacgctcaaacacattcgccagcaactgactgccccgcgccgggtcgcccaacgagtggtcatggctgtacagcaaatccacaaacaccgccccaggcttgtacgccagcaaacgcttgaacaacttgctctgctcgccatagggcatgggccatgagctgtcattgcgcatcaggtaggcatcatcaatcaacaccaccgccacccgctgctgcccaaggctcgggtagtggctggcgaacatacgattgagccactgcgccgacgccttgtcgctggaactggccaggccgaaaggatcaagaatcgccagcaacacgatgatgaccgccagccaatagcggcggtatttgaacagcggggggttggacaacatccatgtctcgattaaaggcacaagcaaggcggggtttttaaccggagtgggagggagtgtcaaacggaaaagtggctaattgccatatcattgctggtatgcgaatcgccattcgcaaaaaagccccgacctattcaggccggggctttcctctgtgggagccgggcttgcccgcgatgacgtcagcccgcgcaccacacgacttctttattgctcaacattccctggcgactccaacaccttcaccacatcatcaatcaccgccttgctcatctcctgcaaataatgcgacgcccaggcataacggtccgtgtcctgcgtcatcgctgcatcttctgcgagcagcttggcgaggtggagcaagtcggaaacgtgatgcaaggcttcatgcagggaaacaccgctgttgacgcggaacagaggttggtcggagtgaaaggaaaagggggtgacgccgagggtggttaacgcagacgcatttgtaacggtcatcggtaaaactcccgtatcaagtgagagctaccacattcgttatcaggcgaattgggtggcagctgtgcgcaggctgataaaccggagatacaggaacccggcagacccgaaggtctcccacgcacagccgccattgcacgaattttgaggcgaaaaaaaaacgcctgcaaatcgggttttgggggcgcttggtgtgcgcctgcatcttgccgggttatcaggcccggtcgctgaattggcagcgacaggagggagggtagcgtggtggggcgtggggagcaatcgggaaagtggattagttgtgtctgctggttttagggtaggcattgatcatagggtggttcttggttttatggatctttcataattatggtctgtctttcatcttgtataaagaggaaacaggggtcagaccaccattattgaaaacatgctctgacccctattttcctcttacacttcttacgcacttttgatgggtgcaccggaaaaaaattcccgtgtgtagatggcgagaccttttgatgcgtgagcactcaatatctgcttaaaaattgcatctttcgctatctcgtccctatcgggtgcggggatacgtcagcttttagcgaaacgacgcacgatcaagccgcttggcaatctgtctcgctcccaaaccagcgacaacaaggatcagtatcagcaaaccggcttttcctaacggaagaaacgcttctacttcggcctccacagtctcaatggtgaaaacagctccgactatgcaagtgatacctgtcatgtaggcaagtggtctggatacgatgagcttgcggctcgcagatgccatgtatacaaagtaaagggtgagcatgcttagagctgcaacgatcctcaaaacaaagccgacccgatgaggggctggaagggacgaatcgatataattgactcccttcacgcctgcaattcgcgctttcgcttcgaagctaggcgcacctcccgatgtgagaatcgttaggaagactgaatcctctgggttcaccaaaaatggtgcgatcgttgcccgtttgtcatctgtcgatatttttgctgtgatgccagcaggagaggtgtcagtgacttgggcacttacaaccaaggcctcattcttcgcaaacagttcgatgggcgtttcaaagtcactgctcaggattggcttagccccatcattaaccacctgcaaaagcgagaggtaaggacgatcaatattgcggccgtttatggttacctggaggtctttgatgccagcttgttgttcaagctgaagggttgttgaagacaggagcttgactgtaatcgcccgggcctcctgttttgactgccatagaacagggacaagcgcgcatacaagcgtgacgacaaacatcacgatatatttccagtcgatcgacttccagttcatcgcgtcattccgttgttacgtcgcttgttacgtttagcagacaaacaaaagccccgcatcgctgcgaggccttgttttgaatggtgccggcaccaggagtcgaacccgggacctactgattacaagtcagttgctctaccaactgagctataccggcgtgttagggcgacgattatagcgattggaaagcttctgtaaacccctgaattctgactatttttgcagaaggagaggttttcttcgaatggcgggttttcctgctccctcgagcgtcaattcctatccccgcaatccacgttgaatttcatgtattccatcacccctgcatctgctctttggagtcgaggacgaccatgtatgcgcgcattcaccacgccgcagcctggctgtctcgcgcagctttgcggctgctgaaaggcccaaaaaaaaccgcataaattacgctttatacgcttaccacaaatgcttatgcacaatcggcaggtagatagcgtgatgaagcagccgttttgtgacagcgttctatacgcgccgcaactgcctgttttgtgtgcgttttattttgtgaacaaaaaatgaccagggtcgattttggcctgtaacgcagatagatactggctcggtaaagatttcatcaacagagttatccacaggggcgtgtaggaaatttcgccccttaatcgcgctcggccagcaccatcaagttgcgcggcgtcagcgttgtttcacagaagctgccgacctcgacgttgtaacctcgctcttgcaggaacaatgctcgatcgagcaccagccacatttccagcgggcgtcgaaacaggcctcttaccagctccaggtttcgcacctcggccaggcggtgccagccgtgtgcctccagcgccgtccaatcctgttcgcctgtggataaaccctttaggttcgccagttcctggcagtagtcagcgtaaggtttgtccagccaactggcgggcagggacggcgttggcaggtattcgtcgcaaccgcgcagctggcgttgcagtcggtcgaagcccaggcgtcgggccatggacgtgtcccgttgctggcgcacgcggttgccggcggtgacggtttcgctcaggggcaggcctaaatcttctatggatagttgcagtcgggatgcgcgcccggcagcggacaatgcctggtagcggtcggcgttgatgcggttgtagcagcagggcgccagtgccagttgtttgcagccggcggcgctggccagttgtagcaggcgcacgtgcaaatcgccgcaggcgtgcagggcgactggtgtgtgtgcggggtcgatcgttatattcgccatgacgtcctgcaggcgatgggctgcgggtaggttatggcggtcactcagggcttggccggatgcgaccagggctgggtcgtattccaggcaggtcaactgttggccgggttgcagcaggcggcggcttagatggcccttgccggcgcaccagtccagccaatgggtgggcgtttcggcaaaattcagcgcggcaccgaaggcttcgatctgttgccacttgcgtccgggtacgtcgacattcaggcggtggcgagcaggttcaagcatgtgcgtgggtagtttatccacagcactgaggtgtagcgcttgagcggccagctgtggaaaaggtgctggcgcaggcaggtcgtgggggtggttgtgactggcttcggcttcggccagcgagcgctggcgcagccatcgggacagcgccggatgttcggcttcccagggtaagtgcagatgggtaaagggccgtggtcgccacagcccttggtgctcgatcaggaacccatccagcgccttgaagcgtgcctcagcgtccttggcacgcatcgacgcgcagccatttttccagcagtttgaagccacgcacgaggatgtaggccatcagcaggtaaaacagccctgccgcgaagaagatctctaccggcaggtaggtgcgggcgatgatggtcctcgccatcccggtcagctccagcagggtcacggtactggccagggcgctggccttgagcatcaggatcacttcgttgctgtaggccggcaggccgatgcgcgaggcgcggggcaggatgatgtagaacagcgtcttgggcttggacatgcccagggcgcgcgccgcttcgatttcacctggcgggatggcctggatagcgccgcgcaggatctcggcgatgtaggcggcggtgtgcagggtcatggtgacggtggcgcaccagaacgggtcgcgcaggtatggccacatgaagctgttgcgcacggcatcgaactgcgccaggccgtagtagaccaggaacaactgcaccagcaacggcgtgccacggaagaagaagatgtagccgtagggcagggcgctcacgtaccagcggcgcgacgagcgagcgatgccgagcgggatcgccagcagcaggccggcgatcaccgcgatggctaccagctccagggtcagggttgcgccctgggccagtttgggcagccacttgatgatcactgcccagttcaggcccaggtcgaagtgcgatagccagctgtagtcgccgctcattgggtgctccttgcaaagccgcgggcggcgcgtttttccaggaagtgcatgctgatcatcgccagcacggtcaggcccaggtacatgaacgctgcgaccatgaagaaggtgaacggttgcttggtgacggtcacgccgatctgcgcgtggcgcatgatttcttcaaggccgatcaccgacaccagtgcagtgtctttcatcaggatcatgaacaggttgcccaggcccggcagggcgatgcgccacatttgcggcatgatcaagcgcgtgaaaatccgcagtttcgacaaccccaacgccacaccagcttcgcggtggcccttgggaatggcgaggatcgcgccgcggaacacttcggtggcgtaggcgccaaagcacaggcccagggcgatcaccccggcggcaaaggcactcagcgaaaggtcggggttaccgaagaactcccccagggcacgcatcaggttgactgtgccgaagtaaatcagcagcacccacaacagctcgggaataccgcgaacgatggtcgaataagcaccgcccagccattgcagcggcttgtacggcgaagtcttggccaaggcgccggcaaggccgagcaccagccccaggcacagggccgtgagcgccagtttgacggtcatcagcgcgccagcggcaagcgccgggccgaatccgtagagatcgaaattcatggtgttttcatatcgcggcaggcattgctgaaagccggcgcgctcaatcgagcgcgccaggcaggccgttcaggtcattcgatgctgaacgggaagtacttgtcgttgatctttttgtaggtgccgtctgccttgatctctgccagggctttgttcaggcgctcgcgcagcgggtcgcccttgcgtacggcgataccgatcttgtcgctttctactaccgggtcgcctttgaattcataggccgaaccgtctttgctcttgagccactcgtactgcacgtacttgtcggcgaggatgccgtccaggcgcccggaggtcaggtcgaggtaagcgttttcctgggtgtcgtagagcttggcttcggtgtccggcagcttgtcttccaggtaggtaccggccagcgttgcacgctgtgcaccgatcaccttgcccttcagataggcggcgtctgtcttgaagtccgctgtggctttgggtgcgatgaattgcagcttgttggagtagtacgggtcggtgaagtcgacggcctgcttgcgttcatcggtgatcgacagcgaggacaccaggaagtcgaacttcttggcgttcagggccgggatgatgccgtcccagtcggacacgtacacttcgcacttctcgactttcatcttggcgcacagggcgtcgccgatgtctttgtcaaagcccacgacattgccgctggcgtctttattgttgaatggcgggtaggccgcttcgatccccattttcaaggtttctgccatggccgtggcgctgaacgccatcgagacggccgcagccagaaggaattttttatagttctgcatgcatgttgctccgttagcggttgctggacatgaattgtttgcagcgcgccgaaagcgggttttcaaacacctgctgtggcgatccttgctcttctaccagaccctggtgcaggaacaccacttcgctggacacctggcgggcaaagcccatttcatgggtgaccagcagcatggtgcggccttcttcggccagtgcgcggatcacattaagtacttcctgaaccatttccgggtcaagggccgaggtgggctcatcgaacaggatgactttaggctgcatggccagggtgcgtgcaatcgccgcccgctgctgctggccgccggagagttgggctgggtaggcgtggcgcttgtcgccgatgccgaccttggccagcagggcctcggccacttctatcgcttcggccttgctttggccgagcacacggcgtggcgcctcgatgatgttgtcgaggatgctcatgtgcggccacaggttaaagttttgaaacacaaaaccgatttcgctgcgcaggcggttgatctgcttgccgtcggcggccatcagctcgccgtttttcgcggccttgagcttgagctcttcaccggccaccaggatctggccctgatgcgggttctccagcaggttgatacaacgcaggaaggtggacttgccggaaccggaagaacccaggatcgagatcacgtcgccgtcgcgtgcggtcagcgagatacccttgagtacctccagctcaccatagcgtttatgcaagttgcggatttcaagcgcgggcgtggcctcggccatgtgcggtcctcattgtgttcgttgcgtgcttcgctgttgggccgccttcctggcgaggcgccaagctagcatagcgtttggatgacagccaacagcgctgcggacggttaaccggtggtctgcggcagggtgtcgcatcggcacagtagcgtgtcgcgccatcaacaaccgaacagccgtttgaaccggaaaaagccacaggcttcgcgtaaaaaagggcgcgatggtgccagctttggccgggtgttggaagggttaaccgggcaaacggtccatatcagcccttatatggagcgtcacgtactttttgtgtgtgtttttggtgcgcctgttcgtcttggatgtgggtcgcacggtaacgctatagcggaataccattgttctcaaagacttgcgatgtctgttgaattgtcctacaggccgcgtcaatcgcggtttcgtaacattttggcgcaaatcttgcgtaaaaaataaagaacgccctgttggtttcttttcacgagaaaggcagcagccgggcgaaccgttttcgcaattcctcgcaaaggtgtgtcaatgagtagtacgcaaagctccaatgacctcgaacaggggctcaaaccgcggcacgtcaccatgctgtcaattgccggcgtgatcggtgccggtttgtttgtcggctccggccatgcgattgctgccgctggcccggctgtgctgttggcctacgcggccgccggcacgctggtggtgttagtgatgcggatgctggccgagatggccgttgcgtcaccggacacgggttcattctcaacttatgccgaccgcgcaatcggccactgggccggttttaccatcggttggttgtactggtggttctgggtactggtgattccgttggaggccaacgcggcggcgaccatcctgcatgcctggttccccgatgtggcgatctgggcgtttaccctgatcattacgctgctgctgaccgcgaccaatttgttcagcgtgaagaactatggtgagttcgagttctggtttgcgttgatcaaagtcgtggcgatcgtaggttttgtgatcctcggcctggcggcgattttcggcttcttgcccaccagccaggtcagcggtgtgtcgcacctgttcgacacccagggctttatgcccaacggcatgggcgcggtcttggcggcgatcctgaccaccatgttctccttcatgggcaccgagatcgtcaccatcgccgcagcggaatcgaaaaaccccggccagcagatcaccaaggccaccaactcggtgatctggcggattggtttgttctacctgttgtcgatctttatcgtggtgtccctggtgccatggaacgatccgaccctggctgccgtaggttcctatcagaccgtgttggaacgcatgggcatcccgaacgctaagctgatcgtcgatctggtggtgctggtggccgtaaccagttgcctcaactcggcgctgtataccgcttcgcgcatgctgttttccctgggccgtcgcggtgatgcgccagcggttgccaagcgcaccaacaagagcggcacgccttactgggcggtgctgctgtccaccggtgcggcgttcctggcggtgtttgccaactatgtggcgccggctgccgtgttcgagttcctgctggccagctccggcgccatcgccttgctggtgtacctggtgattgctgtgtcgcaactgcgcatgcgtcagaaacgtgcggcggcgggcgagaagatcgtgttcaagatgtggctgttccctggcctgacctacgcggtgatggtgtttatcgtcggcaccttgaccatcatgctgttccaggaagcgcaccgggtcgagatcatcgccactgggatcctgagcttgctggtagtgctggcggggttgttcgtggcgagccgccgcaaggcccagaagctaggcgcagccgtgctcaactgacggaatgtgatgcaaatgtgggagggggcttgctcccgatgaagtgtgtcagtcactgagatgtcgactgagactctgttatcgggagcaagccccctcccacattttgatacgtgtcagtctgctgaagttgtcagcgactgagatgctgagcttgcaggtggtattgggagtggcgagccgccgcaaggcccagaagctaggcgcagcagtgctcaactgacggaatgtgatgcaaatgtgggagggggcttgcccccgatggtggtgtgtcagtcacttggatgtcgactgagactctgctatcgggggcaagccccctcccacattttgatatgtgtcagtctgttgaggctgtcagcgcctgggatgctgccacgtagtctgcctggaactgcggcgattcgatccaagccagcgcagcggcctcgtcatcgctgtccgtcgcccactgccgatattcaatcagcgccgccaggataaagtcggtcgcttcctcttcgccttcctgctccagcaccagcgccagcagcgggtgcgccaggaataccgcgcacagtgcctgctggctggtctcccctgcggtgcgcatctcgacgaacagttcggtcaagtccaccgactcaagatcgatacggctgtcgtcgccggcgaacgcatccggcttggccgcgacggcacgctgggtgcggttttgcttggccttggtctttgcccgctgggcgcgtttttgctgcttgtttggcgaggccatgggctcaacgtccttgggttctggatctgggtggggtattgaagcgcaggttgaggtaaatcccaaggaaatccgggcgggtttggtcgttcgtcgcgctcgaccgtcaggccatagatcaataggctacgcctttgtcatctgccagagcgtcctcatgacccgcgatgcccttgagcataaccagatccctctctattttgtcgccatcctgctggccgctgcctgtggtgtatgcacgccgctactggctcacggtttgagcgtattgatcacgcccgccatcgcggtattgatgtacgcgatgttcctgcaaattcccttcctcgatctgcgccagggtttgggcaatatccgctttgtctcggcgttgttattggccaactttgttctggtgccattgctggtgtgggcgctgacccgtggcctgctggggcatcccgcgctgttggtgggggcattactggtgttgttgacgccctgtattgattacgtggtggtgttcacccacatcggcaagggcgactcgcggtcgatgctggcggccacgccattgttgttgctgttgcagttggcactgctgccggtgtacttgggttttatgctgggcgcacactcgggggtggtggttgagatcggcccgtttattgaggcattcctgttgttgatcgtggtgccgatgctgctggctgtgctgacggcctacctggcgcgacgatcaacgcttgtcgacaaatggagcagtgcgtgggcgtggttgccggtgccggcgatggccctggtgctgtttgtggtgatcgggtcgcaaatcacatcggtgatgcgcgacatcgacctgttgctgccagtgcttgcgatctacctgggcttcgtcctgctggcgccgttgatggggatcctggctgcgcgactgtttgcgctgcctgcgccaagtgcacgggcggtgacgttcagtgcttcgacgcgcaactcgctggtggtattgccgttggcgctggcgttgccagaggacgtgcgcgggttggctgccgcggcggtgatcctgcaaaccctggtcgagttggtggccgagttggtctatgttcgcttgatcccggcagtggtgtggcccgcaactcggtaaaaacgtgaatgttcaggttcgttcaggcgctattcagggctgcggtcggcaccatacgccagcgcttcccacctgacaggtcacccgatggatcatcgcaaccgtattcgcctggagtccctgggcctctttctgattgccctgttgttgttcacgttggggatctgggatcagcagccccagggctttgatgggcgctgggcgttgttcatgcaggaaatgtttcgccacggcgcaagttttttccccaccacttacggtcagccttacgcggactacccaggcaccgcgaccttcttcagttttgtattcgctcgctggtttgatgcgccgaaccacctggcgaatgtgctgcccaccgcgcttgcgtcggccggtgtgatcgcgctgatgtaccgcctgctggcgccgttcagtcgcccatgggcatttttgacggtgctgctgacgctgcttaccacccagttgctcgaaaaatcgcgctcggtctgcctcgaccagatgatcgcgctgctgtgtgtcggcagtttctatctgctgcacagtggcgagcgcctggggtcgcggctgcggcaactggcggtgttcccgttgttcgtcctggcctttgccattcgtggccccctggggttgattgaggtctgtggggtggtgtgcgtgtattgggcgctgggcaggccgggcgagcgcgtccggcaagtgctgatccacggcgttatcggcctggtgctgctcgcggtgtgctggtggctgctgatgaagcttgcgcgattgagcggcggggatgcctttgccgatgaagtgttcaagatgcaagtcggcgggcgcctggatgagtccggtgagccgttctatttctacttccagctgagtttgtaccgttacttcccggtggtgccgctggcgttggccaccctggtcgcgctgcgccatcgctggccggagcgctgggtcgacgggcagctgcaactgctggtgcgcctcggggcgtgtggcttgatgattctgctcgggttgtcggtgccgcacttcaagcgcgcttattacatcttgccgatggtgccgatgtttgcggctgttgcggcctatgggctgctccaggcgcaaggttggctgttgggcgtgcgccgttgttacgaagggcttgtcgcagcgttaccggcgttgtgcgtggttgtgttgtttgtgtgtcggaacgcttggcacaagcagggctattggccggatatttccctgccgctgatgattggtgcgttggtggtgttgcaactcgcggcgttgattgcctggcgccggccgttgcgtttggtatggctcagcgtgatcgcactggcggcgcaatggttgttgttggtcgcggtgatagaaccggccaaggacctgcaattcgacacccgacggtttgtcagccaggtggaggcactgcgtgagtcgcagcctggccctttggtgtttgtcgacctggcccgggacacctgggcggtgcgctacatgatgaacctggatcacgatgagcagccactgtttgtcgagcgtcaccagcttgagaaactgagtgcgctaccgcggccatcctgggtgattgtgccgcgcaaggagactgcgctattgagaggttcgccggtggagcaactggcgccaagctttgcggggcggttgaatgacaatccgttgatggtgtttttgctgaagtgagggggcaacttggcgggcctcctcatggataaggtttgtccagctgctcaggaataaagccttcctcgcgcagggatttgataacccctctgatcaaataattatttgagaacccgattgtgtactgccgagcacctggactgatgggaagcagcatcccttggtcgaccagtttttttatttgataggttctttgggcggcggacagtgtcggtagagcgtcagcgatatcgcccgacttgaccaccttcagttggatcgccgtgctcagaattttctcttcaagaggcgttatccatgcgcggtctttcgccaatgcaatggtgggggcaagaatgtgcctggtcaggtagccgtagtccgtcagcctgctgactttctctaattcatctctaatgcctgccagcacatacgtacaccaagcctcaaggccttccttggtgcctgtgtcagcggtggaaagcatcgcgtaatacttttcgcggtcgatacagaagactgccgtcggattcaggactcggccgccagcgctgacgttgaagccgtacttcatcaacattgcgtacgtcagaaggcgcacgacgcggccattgccgttgccaaatgggtggatccagccaaaccggtggtgggccagcgcgactttcatcagatcgtacttgggggcatcctgcttattcacaaaggcgacgagttcttgcatgtagcctggcaccatcaccgcctcgggcgggaggtgatcggactgggcaatgctgaccccggactcgcggtaagcacctggcgtacgatcaccttcgcgttgcagtccctggacggtgattgagtgaagctctcgaatcgcaaactccgtgagatcagcgccggtctgcatgatgctttcgacgtagtccatggccttttcgatattcgcaatttcccgcaacggatctgaagcctcggcggccccttcaactttgctttcgatgtagtcggccagtgtcgtgtggttgccctcgatacgtgcagagcccaggctttccagcgtatgaaacagggctttcaactggaaaaaaacagcaggcggtgtatcgccacccagttgcaggcggcgcaggtgttccagctcgctcagaacatcaaccaggcccgagtcgaacgaggggttcaatagctccagatcgtgatgagcaaactcgggcatatggaaagtatctccaattgatattttgattatctcgaaagcaggctgatttgatgcccgtagggaaggcgttaggggcctgatgaggccctacactatctcaaaaaaacagttcggataagtgaaaaacatcccaaatcaaactaggtccggttggctttggtcagggtgcccaaactgtatccggacgggagcaagctatttgcagcgatacccctcaggcatcgtcaccgtgtaattgcgctgcacgcggtcctggaagttcaggttctgcaggccctgctgcaccaggaaggcttcgaccttggccgcctggcaatcgtcgttataggacgatactcgaagcacgtacacggcgcgcctgctcgcctcgtcccgagcggtagcccggaaggtggtgagggtggtgtaaccggtgcgttccgatgtgcctaccgggccataggaggtgttcggggtgctggtgcaggtcagttgatcggtctttttcttattcttcttgcactgtgtggtggtgctgtttgccacctggccatactcggtagcggtgtagcggtaagtgacctgcttgctttcgacgtcaagggtgatggtcattttgatcggtgcatggttcttgggcagggtggtgtcggtaaagacattgcgaaagccctggtccttcatggcgctgaccatgtcgcgcaggtagtaccgggcattgagtgcgttttcgtcgctgcccccgacagacgtcaccagtacggttgcctggcggtcgaagtgatagtccggatcgggtgtcgcgttgatcgctacgtccatttgcgtggcgcatccactgagtagtgcagtcagcagtaatagcgagcagagcaagaggcgtgtcatgaaagaaaccttacagctgtgaatggggtaaagggtggacgattgaagccagtgaaaaacaagcgctcaagcgctttgtgcaacagggctcggtcactctatcgccgtattgcgttcttctgtctcgatggccccctggcgcgtagcttgccctgcgcaggatggggtcaggcaaaacacaaagggtgcgcgcacctcgacttcaccatccttgagaactgacgcaggcggagcaggcattggcgatgcggctggaagagatgcctgcacggcagcaacaaaaagctcagagcctgagtgactgatcacgcgctgacgcaacaagttgccgtgggcatcgatgatgaattcaatattgacctggccttccagcccctgcgcctgggcgtttgccgggtaaaatttgaacaggtgtatatgggttatcagctgttgttcccatagctgctgttctgccagttgctctggggaaggggttcttgcgcaggcgccaagcagcagggcaagtgcgatccagcaatacttcatacatatttccttgagcattttttgcgtccgtactatctggcgccacagagtatttcaaatccaggcgcttggaaggctcactccctcgacggctctgtcgatgggcctgatcggtgccggtatcgtgattgcctgactcaaggtgctcctgctcggcattcgggtccagggtgatccagagcacattaaatcgcaggcaataaaaaaccccaaggaacacattgttccttggggtttctcggtattttggtgcccagagacggaatcgaaccgccgacacggggattttcaatcccctgctctaccgactgagctatctgggcaacggggcgcattaaacgggtttttcagggggtcgtcaagcaagttttcaaaaaatatttaattattaccgtcgcttacgtgcagaccccggtttttgatcaattattgagcaggcggcacgtagccgtcggccttggcgtattcctcgccggaaaagaacttgtccatttcgccggccaggtatttgcggtcttcggcgttcatcatgttcaggcgtttttcgttgatcagcagggtctggtgtttcaaccagtcgccccaggctttggcggacacgttgtcgtaaatgtcctggcccttggcgcccggatagggagggcgttccagtccttccaattcttctttgtacttgcggcacattacggtgcgggtcatgacgaaactcctgcgttcaatacgtcggccgcgcgcttgagcaatgttttcaccggggcggcaaggcccaggcgcggcggggtggcgaggttataccagagccagtcggcctcggccacgtgatgggcggattcctcgacctggaccagccagggttcgatggccaactggaagtggctgaaggtgtggatcagtccggggagctcctgatgcttgcccagttgcagcgcgtgctggttggccaggtgatcgaggtcctccaggtcgtccagttccggcaagctccacaagccgccccacaagcccgtggaagggcgacggtagagcagaatcgcgccctcgctgttcgccagcatcggcatcagcgtgcgcttttgcgggatggccttgcgcggcttggggatcgggtagcgtgtctccaggcctagcatatgggcttcgcagcctttttccagcgggcacagcaggcagctgggtttgctgcgggtgcaaagggtggcacccatgtccatcatcgcctgggtgtaggcgttgacgcgctcaaagggtgtgaagcgctctgcggtggcccacagttgtttggccaccttgggctcgcccgggtagccctcctgcgcggtaaagcgtgccagcacgcgcttgacgttgccatcgaggatcggcgcgcgcaggcccatgctcaggctggcaatcgcgccagcggtggacaggccgataccgggcagctcggtgagcttttccacgtcgcggggaaactcgccgccgtactcgttcaccacgatcttggcggtcttctgcaggttgcgcgcccgggtgtagtagcccaggccggtccacaggtgcagcacttcgtcttccggcgcggccgccagggcttcgactgtcggcagagacgccatgaaccggtcgaagtaattgagcacggtgctgacctgggtctgttgcagcatgatctccgacacccacacccggtaaggcgtgatgccctgctgccagggcaggtcatgacggccgtggcggtcgtaccaatcgagtaccgccgctgaaaactgctcgtctctcatcggttgaacagacctttcaaggcgtccttgatttttggattgaccttgtcgagcttctcttccaatttctcgttaaggcgattgccggcagccttgagggcgacctggccaaggccatccttgtccaggcggcaggccttggcacccagttctagtgggccgcggcagcgcaacggcacttcgataccctggaagttggtgccgacctggcaggccgggtctggcacctcgcgctggtcgccttcgacgatgatgccgaggcggtagtccatgcccagcacgcgcaagtcgacatcgccgttgccgttgactgtcagccccgggatgcgcactttcaggtcggggttgctggccacgccgttacggaacgtcaggttaccgcgcagttcctggaacggagtgtctttgcctggtggcgtgctgctcaaggtcttgcggttgagcagggcgataccggtgcagacctgttgctcgatgttggcgttgagcagtacgccattattgatcacgaagctggcggtaccgttgaggctgtcgatcagggccttctggctgttgccacgcccagtcaggttgctgtccagggtgacctggcctttcactggcgggtttttcccctgggcttgcaggatcttttccaccggcacttgcttgatttgggtttgcagtgcgagcagtggaaggtcctggcgcacatcgagcgtgccgttggcctggaaggtgccgttgtagagcccgccactcaggctatcgagcttgagctggccgtcgatacccgaagctatcagcgccgcgttctggatcggcaactggttcagggtgagttggccgaacgccaggtcggcgttgatatccaggctgcgcaggcgcgtcagtggcagtagtttgtccgtgctccaggcgcctttggtcggtgcgttcggcaatggcgtgctgcccccggctgccatggcgccggcttcgctgctttgcacttcggcctggcgtgcggcggttgcgcctttggccgcttcggatttggccggcagataattgtcggcgttgaaggtatcggccttgagctgtacacgcagggactgcttggcgaaatcgtccacagcgacgcggccggtgaaagtgctttcgtcaagtttcaggttcaggttttccagggccacgctggtgggcgtgcccttcagacggctgaccagctcgaccttgctcaggctgcccggagccatggccggcagcgggtggccgatgctgtcgaggaacttggccaggtcaaactgggcgacagacagggcgccgctgatttgcggggtcttgtccaggtcgttggccttgagctcgcccaaggcgcgcaactggttggccgagagtttcaggttggtccattcggcgacgttggccgccaggtccaccagcagttggccctgggtggagaagctcacggtcttgccttgcaacggctcgccagtggcttcgccgctaaagcgcatgtcttcgaactggtagcgcttgagggcacgctggatgcgcaagttgccgttcagctcggtcttgacgcgcatcagcggctggttgctgcccaggaacgcggtgagtttcagtggaatgctggcgccttcgtggatcgcgccggcactgagctggatgctttcagcactgaattgcttgccggtctgttcatcgttgtattcgacgcgggcgttgttgatggtcaggctgtcgatatccaggcggatcggttgtggcggtttctccggcttggtttcagccaccggttccactggcgcaggcgcggctgcgggggcgtcggcagtcgcatcgggtacgttcttgccgatgtcttcccagttgccatggccttgcttgtcgcggttcaggcgcaggttcaggccctcgacacgcacatcgctcatctgcacttcgcggcgcagcagcggcagcacgcgcaccgacaggccgagcatctgcaaatcggcgaatggttgagttggtgcggtcagggtcgcgacgctggcctcgtgcaattccaggcccagccaggggaacaggctccagccgatatcgccattgagcgtcagctcgatgtgggccttgtcgcgggctatctggcgaatttcttctttgtagtcgttgggatcgaagaggtgggtcagggcaaagccgagcgccacaatgatcagcaacagcccgagaagtaccagacccaggattttgccgaacgctttcatgggcgagtccttgtatgtcgatttcaaaatttagccgcagagtataacgcccggcggcctgcgtcagttcacggatcgttacattgtatccagtgacgcgaaaataggattttgacgtcagaaaaatgcagataatccaaaaaaggtagtggcagtttgatttttctgtcatccactggtgctaatctctgcacgttcgtccgccttctgcgacttaacgtcgcgcctaaaagggagcttcactcaacaaaacggccacgctttgcgtgcaaggccgagggagagagcgcctgacggacgcatattaataaatgggggaaacaccaatgagcactagtactgtggccggcgccgtcgccgcacagcccgcgttcctgtccaaggaacgcatcatcgccaagccggggttcaaccgctggctggttccaccggccgccctggccatccacttgtgtatcggcatggcctacggcttctcggtattctggctgccattgtccaaggcgctggggatcaccgcaccggtggcttgcgcgccggacatgagcttcatcgcacaagtcttctcgtctcaatgcgactggcccatctccatgctgggctggatctacaccctgttcttcatcttcctgggctgctcggcagcgatctggggcggttggctggaacatgccgggccgcgcaaggccggggttgtctcggcactgtgctggtgcggtggcttgctgatttctgcgctgggtatctatacccaccagatctggctgatgtggatcggctccggggtcattggtggtatcggcctgggcctgggctatatctcgcccgtatcgaccctgatcaagtggttcccggacaagcgcggcatggcgaccggcatggcgatcatgggcttcggcggtggcgcgatggtgggcgcacccctggccgcagcgctgatgggccacttctcttcgccgaccagcgtgggcgtgtggcagagcttcgtggtcatggcggcgatttacttcgtgttcatgatcggtggcgcattgctgtaccgcgtgccgccgaccggctggaagcctgagggctggaccgcgccggcgaaaaaagccagcaacgcgatgatcactcaccgccacgtgcatgtgaatgtcgcgtggaaaaccccgcaattccgcctggtatggctggtgttgtgcctgaacgtatcggccggtatcggcatcctcggcatggcctcgccactgttgcaggaagtgttcggcggcaggctgctgggtgttgacgtgccatttggccagttggatgccggtcagcttgcctccattgcggccattgctgctggctttactggcctgctgagcctgttcaacatcgggggccggttcttctgggcgtcgttctccgattacctggggcgtaaaaacacctacttcgtgttctttgctctgggctttgccctgtacgcgctgatcccgaacctggggcacctgggtaacgtcgcgctgttcgtggccgccttctgcatcgtgctgtcgatgtacggcggtggttttgccaccgtcccggcttacctggctgacctgttcggtacccagatggtgggtgccatccacggtcgcctgctgaccgcttgggcggctgcgggcgtgttggggccagtattggtgaactacctgcgtgaatatcagctgagcattggcgttgaacgcgctgcggcctacgacatcactttgtacatcctcgccggcctgctggtgctgggctttatctgcaacatgctggtacgcccggtggccgacaagtacttcatgaccgatgcggaacttgccgccgagcaggcgctggggcatgacaaaggtgccgatgcgaccaccgtactggagtggaaagcgtccgccggcagcaagccgttggcggttgccgcctggttggtggtaggtattccgttggcgtggggtgtgtgggtgaccctgcagaagaccgcggtactgttccactgatatcagctgtgggagggggcttgccccctcccacattggatgcgcggagttttcataagtgggttcgcacctgtacgcacatgtctatccccgacactccatcagtcttatcccctccgatgtttctgtttagcgcccgcgcccctataatggctgcctttttcgcccaatgattttgcggagctggtgatggccgaacgtaaggcgtctgtcgagcgcgacactctggaaacccagatcaaagcctcgatcaacctggatggcaccggaaaggcccgatttgatatcggtgtaccttttcttgagcacatgctggaccagatcgcccgtcatgggctgatcgacctggatatcgtcggcaagggcgacctgcacatcgacgaccaccacatggtggaagacgtgggcatcaccctcggccaggcctttgccaaggccatcggcgacaagaaaggcatccgtcgctacggccatgcctatgtgccgttggacgaagcgctgtcgcgtgtggtcatcgacttctccggccgcccaggcctgcagatgcacgtgccctatacccgcgccaacgtgggccgcggctttgacgtcgacctgttccaggaattcttccagggcttcgtcaaccatgcactggtcagcctgcacatcgacaacctgcgcggcaccaacacccaccaccagatcgaaaccgtgttcaaggctttcggccgcgcgttgcgcatggctgtggaagtcgatgagcgcatgggcgggcaaatgccgtcgaccaagggcgtcctgtaatgcagacggtcgcggttatcgactacggcatgggcaacctgcactcggtggccaaggccctcgagcacgtaggcgccggcaaggtgctgatcaccagcgatgccaacgtgattcgcgaagccgaccgtgtggtgttccccggtgttggcgcgattcgcgattgcatggccgagatccgccgcctgggctttgacagcctggtacgcgaggtcagccaggaccgtccgttcctcggtatctgcgtgggcatgcaagccttgctcgacagcagcgaagagaacgacggcgtcgactgcatcggcctgtttccgggccaggtgaagttcttcggcaagggcctgcatgaagacggcgaacatttgaaagtcccgcacatgggctggaacgaagtgcgccgcaccgtcgaccacccgctgtggcatgagatcccggacatggcgcgcttctacttcgtgcacagctattacatcgccgccggtgacccgcgccaggtggtggggggtggacactacggtgtcgatttcgccgcagccctggccgacggttcgcgctttgccgtgcaattccacccggagaagagccatacccatggcctgcaattgctgcagaacttcgccgcgtgggacggtcgctggtaaatggccaagaaaccgaaaccgccgatcttgaacctcacgcccgaacaggagcgtgcggccaccgacaagatcaagcggttcatggaggaccgcttcgagctcaagctgggttcgttcgaggtcgccgagattcttgagttgttcaccaccgaagtggcgccgcattattacaacagggcgattttcgatacgcagacgctcctcaaagaaaggttcgaaagcatcgaaagcgacttgtggtcgcttgagaaaccctgattccccaagcattgctgaatatcgaataaggtttgccagatgctgattatccccgctatcgatctcaaggacggcgcctgtgtacgtttgcgccagggccgcatggaagattccacggtgttctccgatgacccggtgagcatggccgccaaatgggtggaagggggctgccgtcgcctgcacctggtggacttgaacggtgccttcgaaggccagccggtcaatggcgaggtggtcaccgcgatcgccaagcgctacccgaacctgccaatccagatcggcggcggtatccgttccctggagaccatcgagcactacgtgaaagccggcgtgagctacgtgatcatcggcaccaaggcggtgaaagacccagccttcgtcgccgaagcctgccgggcattcccgggcaaggttatcgtcggcctggatgcgaaagacggtttcgtcgccaccgacggctgggctgaaatcagcaccgtgcaggtgatcgacctggccaagcagttcgaagccgacggcgtgtccgccatcgtttataccgatatcgccaaagacggcatgatgcagggctgcaacgtgccgttcaccgcagccttggcagcggccacgaagattccggtgatcgcgtccggcggcattcacaacctgggtgacatcaagtcgctgctggacgccaaggcgcctggcatcatcggcgccatcactggccgagcgatttacgaaggcaccctggacgttgcgcaagcccaggcttactgcgacgcctacaacggctgaggactgaccatggcgctggccaaacgcatcatcccttgcctggacgtcgacaacggtcgcgtggtcaagggtgtcaagttcgagaacatccgcgatgccggcgacccggtggaaatcgcccgtcgctacgatgagcaaggtgccgacgagattacctttctcgacatcaccgccagcgtcgatggccgcgacaccaccttgcataccgtcgagcgcatggccagccaggtgtttatcccgctgaccgtgggcggtggcgtgcgcaccgtgcaagacatccgcaacctgctcaatgctggcgcggacaaggtctcgatcaataccgccgcggtgttcaaccctgagttcgtcggcgaagccgcgcagcacttcggctcgcaatgcatcgtggtcgccatcgacgccaagaaggtttccggcccgggcgaaaccccgcgctgggagatcttcactcacggcgggcgcaagcctaccgggctggacgcggtggagtgggcgatgaagatggaaggcctgggcgccggtgaaatcctgctgaccagcatggaccaggacggcatgaaaaacggtttcgacctgggggtaacccgcgccatcagcgacgccttgggcattccggtgatcgcctccggtggcgtgggcaacctgcagcacctggccgacggtgtgctcgaaggccacgccagcgccgtactggcggcgagtattttccactttggcgaatacaccgtacccgaggccaaggcctatatggcagcacgcggtatcgtcgtacgctaaacgctgctggacaccatggcaggctcgcggcactctctgcgcttgccatggattccggtagccttcatgttcaaacacctgctgctcgccctcgccagttcctccatgctcatggtggctacggcacacgccgatgaatcgtctgacacttccctggtgctgctgacggaaaatttcccgccctacaacatggcgaaaaacggcaagaacttcgccaaggacgagaacatcgaaggcatcgccgtggacatcgtgcgcgagaccttcaagcgcgccggtatttcctacaacctcaccctacgttttccttgggagcgaatctacaagctcgccctggaaaagcccggctacggtgtatttgtgatggcgcggctgcctgaccgtgaagccttgttcaaatgggtaggccccatcggcccggatgattgggtgttactggccaaggccgacagcaagatccagctcaacgaccttgagcatgcccgccgctacaaaataggcgcttacaagggcgatgcgattgccgaaacattgggaaaacaggggctcaatccgattgtcgccctgcgcgaccaggacaatgcgcaaaaactcatggacggccagatcgacctgtgggccaccggcgatcccgctggccgttacctggcgcgtcaggttggcgtgacagggctcaagaccgtgttgcggttcaatagcgcgcagctctatcttgcgttgaacaagaacgtgcctgatgaggtggtcgccaagctccaggcggcgctggatgagttacgcaagagcggtcgtgtagaggaaatcatggcgcgttacctctaaagctggcagttcccttgcagcgcaggggaatcagcagaataaacgcggtcaaaaatgtgggagggggcttgctcccgatggcggagtgtcagtcaatacattcggggctggcccaccgcatcgggagcaagtcgaatcgtcgcaccgcccctcccacattggatcttcgcaaccttcatttagcggtaaatgccgtctttgccgtgcccggccatagcccgattactgcgcacactgatcatcaacttgatatcgatccactccacgccctgggccttgagcttgggcagttcgcgctccagcaccgccagggtctgtgggtaagggtgcccgatcatcaccgccgacccctgcttatgcgccagcttgattgcggtttgcagttgggtggtaatcgccgcctcggtgcgttcgtcatcgaggaacacatcccgcgaaacatgcgccaggccaatcttctgcgcctcggcggcggcgacggtttgcgcgctggtacggctgtctacgaagaacttgtgacgtcgctgcagctcggccatcaaccatgccatcgcctgcggctgcgccgtcatgcggctgcccatatggttgttgataccggcggtatagggcacggccttgaatgcagcgtccaggcgcttgccgagttcttccaccggcagttcggggtgccaggcgaagggcccggtggccgggtccatgggcatgtgcaggatcacgatcttgccggccttgtgggcctcgcgggcgaattcggcggcgtggggcgtgtcgggcatgatcgcggtggttaccggcccaggcagggccagcacacgacgatcccgggtcaggttttgcccgaggtcgtcgatgatgagggtcaggtaggctttgtgtggctcgctggccgaggtcgcttgagcgaccccggccaggctgcacagcacagcgatgatcaggaaaaaacgcatgatcaacggctgcgggtgatgctcaggcccttgagcaggctcagcgcctgggccaactgatagtcatcgtcctgcggcatcggcttggctttggcgccgctgccggtcggctggtcggcgccgccgttgccattgcccaggtgaccttgcaggtcggcctctttgtagtactcgctgtcgatctcgttggtgatcttggccttgcgcacttcgatgtccggcacgatgccctgggcctggatcgagcggccgttcggcgtgtagtacagcgccgtggtgatcttcagcgcccgctcattgttcagcggcaacacggtttgcaccgagcccttgccgaaggtggtggtgcccatcaggacgccgcgcttctgatcctgcaaggcgccggcgacgatttccgaggccgaggcgctgccgccgttgatcagtaccgccagcggcacgttctcgctcaggtcgttgccggtggccgagaagcgcagttcggagttggcgatacgacccttggtgtagacaatcaggcccttggtaatgaagtggtcgaccacttccaccgccgattgcaacacgccgcctgggttgttacgcaggtcgagcacgatgccgttgagtttcttgccgttgtccttgcgcagcttggccagggccttggccacttcatcgccggtcttgacctggaactgggtgatgcggatatagccgtagccagactccagcaattggctcttgacgctcttgaccgtgatggtcgcgcgggccagggtcacgtcaaacgggttgccgccgtcccgtaccagggtcagggtgattttctggccgagcttgccgcgcatcttgtcgacggcctcggtcatgctctggccgcgggtcggctggccgttgatcttcacgatcaggtcgccggcctggatgccggccttggacgccggggtatcgtcgatgggcgagaccaccttgatctggccgtcctcggagcccacttcgatgcccaggccgccgaactcaccgctggtgctttcctgtagttcagcgaaatcttccgggcccaggtaggctgagtgcgggtcgaggttgctgagcatgcccttgatggcgttttccagcagggtcttgtcgtctacgggttcgacataagcggccttgatccggtccatgacctcggcaaaggtgcgcagctcgtccagcggcaatggcgccttggtggtcgcggccatggcggcgggtgcagccggtgcggtctggtcggcgaaagccaggggcgcgccgatcaccagggcgatcgtcaaggccaacgaagtgaggcgggacaaatgcagcatgtcgaacgaactcctaatgtagatgcgaccctatccttgggatctgcaccattgtgcaggatcgctcgggcgaccctgctgacgaatagcgaagtacagcgccggggtgtcctggccgccactggtaccgacagtggagatggattcaccggcttttacaacatcacctgccgacttgagtaatgtctgattgtggccgtaaaggctcaaatagccattgccgtggtcgagaatcaccagcaagccggcgccccgcagccaatcggcaaacaccacgcgcccaccgtggacggcatggacctggctgccggccgaggcgctgatcatcaccccatcccacttggcgcgggtgtcatcgccacgggtttcaccgaagcgtgccagtagtcgaccatcaactggccatggaagtttgccccgggctgatgcaaaagggccgccgaacgactcgccgctgctggacaccagcgggccaggggctgcgcgtgccggtttgcgcggtgctggcgcgtcgctgctggcggccagttcggcctcacgctggcgctttttttccgcttcctgctgggcgatcagcgctttttgccgcgcctcttcggcctcgcgtgcctggcgggccagggtttcttcgatggtcttgagcactttggccaggtcggcctggtcctgctcgcgtgcctggagcttggcgtcgcgggctttcacgtcgttgttgagcttggccagcgcttgctggcgttccttgcgtaccttgtccaactggtcgcgctgggtatccagggcgcttttctggtcgagcagttgtgactgctggtcggcaatttcctgttcgacgttggccaactggcgcagggtttcgttaaaacccttcaattgcgccaggcgcgcctggctcaggtaatcgtaatacgtgagggtgcgggcgaatttttccgggttctgctggttgagcagcaacttgaggtattcctggcggccgctctggtacgcggcacgggcctggatcgcgatcaggcgttgctgttcaacgcgtgcgctctggagtttttttttctcagcgtcgagtcgctccagttccgactcgctcttctttaattctttttgcaactcctggacctgcttctcgagcttgcccatttcggtttccgtgccgcgcaggtctttctgcacgccggatttttcttcctggagcttgcccagcagctttttcagctcggcaatgtcctgacgcgtagcgtccagttgttgttgggtttgtgcacgctcatcggcaaaggccggttggagcaggcagacaagagcgagggttatcaaggcgcgaagcatagaggcgggcgacaccagggaaagggacggcctagtatgcccgccaagcgctgcaaaaaaaacgcccaattggggcttgcgggcaagataggtgccgagtggcagtggtatggcaaaaagatatctaccaaacgctgcaaagctaatgtgggagggggcttgctcccgattgcggtgggtcagctacttataagctgactgatacaccgctatcgggagcaagccccctctaacactgttttgtgatgatgtcgaaatcagaccaggattgaggtcccggtcatctcttttggcttctccagccccatcagcatcagcatggtcggcgccacatccgccagcacgccgccatcacgtaccttgaagtcgcgcttgccaacatagatgaacggcaccggctcggtcgtgtgggcggtatgcgcctggccggtggattcgtcggacatctgctcgcagttgccatggtctgcggtgatcagcgcttcgccgccgactttttccagggcgtcgacaatgcggccaacgcacaggtccaggcattcaacggccttgaccgccgcttccaggttaccgctatggccgaccatgtcgccgttggcgtagttgaccacgatcacgtcgtaacgctggttgtcgatggcatcgacgatcttgtcggtaacttccggcgcgctcatttccggctgcaggtcgtaggtggcgacttttggcgacgggatcaggatgcgctcttcgcccgggaacggttcttcgcggccaccggagaagaaaaaggtcacgtgggcgtatttctcggtctcggcgatgcgcagttgggtcttgccgttcttcgccaaatagtcgcccagcacgttttccaggctgccgggggcgaaagccgacggcgccgggatgttggcggcgtattgggtaagcatgacgaactcgactttcggctggcgtgcgcgctcgaagtccttgaaaccctcatcgacaaacacatggctcaactcgcgggcacggtcggcgcggaagttcatgaacaccacggcatcgccatcttcgaccttcaccggttcgccgatggtagtggccttgacgaactcgtcgctttcgccacgggcgtaagcggcttccaggccttcctgggcggtggcggcatggaattcggcctggccgtcgacgatcaggttgtaggcctgggacacgcggtcccagcggttgtcgcggtccatggcgaagtaacggcccaccaggctggcgatgcggcccttgcctagggcggcgaaggtggtgtcgagcagttcgatggacgattgcgcgcttttcggcggggtgtcgcgaccgtcgaggaaggcgtgcaggtagatcttgtcagccccgcgcttgaaggccagttcagccatggccaccaggtggtcctgatggctgtgtacgccgccgtcggagagcaggcccatgaagtgcacggccttgccggcggcgacggctttatcgaccgccgcgcagatggtcgggttctcgaagaactcgccatcgcggatcgctttggtgacacgggtgaagtcctggtataccactcgtccggcgccgaggttcatgtggccgacttccgagttgcccatctggccgtccggcaggcccacgtccatgccggaacctgagatcaaaccgttggggacggtggcggccaggcgatccagtaccggcttgttggccgagtacacggcgttgtcgtggtggctttcactgtgtccgaagccatcgagaattatcaggaccaaaggtttaggcgtagtagtcatagatcctctcgcggcggtaataaaggaagacaattgaaaagggagtggcagtttaaagcgaagttccaaccacgtcaccgctttacgggggttggccgcccctggcgcctgtgtatacttaccgccattttaacgccctggaacctccttgatggttgatcacctgattgcatttgccactgcccactacctgctcgtgggtgccttcgtcatcctgctggcgctgctgatcgctcatgaactgagccgcggtggtcgcagcctgagcacgtcggagctgaccgcgctggtcaacaaggatgaggccgttgtcgtcgatattcgcccggccaaggattatgccgccggtcatatcgtcggtgcccttaacatcccgcaggacaagctgatcgcacgcttggccgagctggaaaaatacaaggccaagaccatcatcctcgtcgatgcccaaggccagcactccggcacccacgcccgcgagatgctcaagaccggctttaccgccgccaagctgtcgggtggtatcagcagctggcgtggcgataacctgccgctggtgaagtgatatgagccaggttgtcgtgtattccagcgattattgcccttattgcattcgagccaagcagttgctccaaagcaagaaggtggccttcgaagagatcaaggtcgatggcaagccccaggtgcgcgccgaaatggcccagaaggccggccgcacgtcggtcccgcagatctggatcggcgccacgcacatcggtggttgcgatgacctgttcgccctggagcgcgccggtaaactcgacgcgctgctgctcgtctgactcctaaccccttaaagaccccaagatagagaaggatctgcgatgactgaccaacagaacaccgaagcagcagaaacccaaggcccacagttttcgctgcagcgcatctacgtgcgtgacctgtcgttcgaagcgccgaaaagcccggccatcttccgccaggagtggaccccaagcgttgcgctggacctgaacacccgtcagaaagccctggaaggtgacttccacgaagtcgtgctgaccctgtcggttaccgttaagaatggcgaagaagtagccttcatcgctgaagtgcaacaggccggtatcttcctgatccagggcctggacgaagcgtccatgagccacaccctgggtgcgttctgcccgaatatcctgttcccgtatgctcgcgagacgctggacagcctggtcacccgtggctcgttcccggcgctgatgctggctccggtgaactttgatgctttgtacgcccaagaactgcagcgcatgcaacaggaaggcgcgccgacggttcagtaatctcgaacccgacgcagcacccaatgtgggagggggcttgctcccgatagcggtggaacagtcacttagatgtcgactgacactccgccatcgggggcaagccccctcccacatttgttttgcgtgttatttgaaaccgagttggcgccagccttcgtagacggcgacggccacggtgttggacagattcaggctgcggcagccttcgcgcatcggcaagcgcaggcggtggccgtcgggcagggcgtcgagcacgtcggccggcaggccacggctttccgggccgaacaggaaggcgtcgccttcggcaaagctggcatcatgaaacggccgtgagcccttggtggtgaacgcaaacagccgtggatggcccaggctttccaggcagctggccaggtcggcatggcgctggagggtggcgtactcgtggtagtccagcccggcgcggcgtaggcgcttgtcgtccatgtcaaagcccagcggctcgatcaaatgcaggtggcagccactgttggcgcacagcctgataacgttgccggtattcggcggaatttctggttgaaaaaggatgacgtgaaacatgcacggctccgaaggcaaagatgcgctgcattctacccctgaagacgaccccaggccgaagctattgccgcgggtcttgggttcgttggcgattgtcggcttgatgattggcctgatgattggtcgcctgaccaccccggacccggttgagctgctggaggtaatgcctgcggtcgacggtgtggtggtgtggttcaacagcgagcccaagctgcatggcgaacatatcgatggcaccgtggcgctgctgttcgatgcactgggcaagcctgccggcgggcaacttaaggtcaatgacaaggatgtgaactggcgcgtgcgcaagaccgatagcggtttgctgctgaacctggtggcggcgcggccattgcgaggggaatggaaaggcgagcaggtcgatgaccgctggcggctggaggtccatctccaagagcaataaaagagggagttcccggcctgcctgtaccagggctcccaaaagcgtgaagcccaaaggctccgtataaaagaggggattctcggcctgcctgtaccaaggtccccgaaactggatagtactggggttgttgcagggcgcgtgccagagtcgtcgatttgtgccaaataatgtcttcagaaagccaaaagccccggattacggggctttggtgtttttgcagctcaatattttccgggctgttcggttgtttcatctttgaaaggtctgcccgatgccggttcatggtgcatcgaagcggtgcacaatcctgcggccttgtagagatccaaatgtgggagggggcttgctcccgatagcggtgtatcagtcagcactctgtagctgacccaccgccatcgggagcaagccccctcccacattagactttccagtggatctgggaggtgtgatcaggcgtcatcgctttcgtcgtcgtccccgccatccaccttcatccccagctccttgatcttgcgcgtcagggtattgcgtccccaaccgagcaacactgccgcatcgcgacggcgaccggcggtgtgcttgagggcggtctcgatcatgatccgctcgaacgctggcacggcgctgtccagcaggttcgactggccgcgggccagggcctggtcggcccattggcgcaaggcctgttcccagttggtcacaggggccgaatcctggggcaggctcagcagctcaggcggcaggtcgctgatatgcacttcgcgcccggacgccatcacggtaatccagcggcaggtgttttccagttggcgcacattgccgggccacggcaggttcttgaggtattcctcggtctcgcttttcagcagcttcggctctacggccagctccagggcggcgcggctgaggaagtggcgggcgagggtgggaatgtcttcgcggcggtccgacatgcgtgggatatggatacggatcacattgaggcgatggaacaagtcctcacggaatttgcccgcgtgtaccagggtttccaggttctggtgggtggcggcaatgatgcgcacatcgaccttgaccggcgtatgcccgccgacgcgatagaactcaccgtccgccaatacccgcagcaagcgggtttgggtatcggccggcatatcaccgatttcatcgaggaacagcgtaccgccgtcggcctgttcaaaacgcccgcgccgcaggttggcggcgccggtgaacgcacctttctcatgaccgaacagctctgactccatcaagtccttggggatcgccgccatgttcagcgcgataaacggcgaggccgcccgtgggctgtggcggtgcagagcatgagccaccagctctttgccggtacctgactcgccgttgatcagcacggtgatgttggagtggctcaagcgcccgatggcgcgaaaaacctcctgcatcgccggcgcttcaccgatgatttccggggtgcgggtcagggtgggcggggcctcctggttctgttgttcctgggcgtgctggttggcacgcttgaccagcgctacggcctcatccacgtcgaatggcttgggcaggtactcaaaggcgccgccctggtaggacgcgacagcgctgtccaggtccgagtgagcagtcatgatgatcactggtaggcgcgggtgctgctcgcggatgcgtgcgagcaagtccaggccactggcgccgggcatgcggatgtcagagatgatcacgtccggctgctggcgcgccaggcggctcatcacgccgtcggcgctgtcgaagctctgggtggtcatgccttcctgttgcaaggctttctccagaacccagcggatagaacggtcgtcatcgacgatccagacagtttcactacggctcatgtcgtgggggctccttgttccaatggcaggaagatcgagaacgtggtgtggccgggatggctttcacattcgatcaggccctgatgctggctgatgatgttctgggtaatggccaggcccagcccggtaccgtccgggcggccgctgaccatgggaaagaaaatggtttcctgcagttcggcggggatgcccgggccgttgtcgatgatctcgaccttggtcaccaggcgatgacgcacatggccgatggtgaactggcgcagggcgcgggtgcgcaggctgatgcggcccaggcgcagctcgttctggctgctgatggcctgcatggcgttgcgcacgatattgagcaccgcctggatcatctgctcgcggtcgatcaatacgtcgggaatgcttgggtcgtagtcgcgtaccagggtgatgcagccctggctctcggcctcgaccaactggcagacgcgctccagcacctcgtgcacgttggtcaacgccagggacggcaatttgttggagccgagcatgcggtccaccaggttacgcagacggtcggcctcttcgatgatgacgttggtgtagtccttgaggtgctcctccggcagctcccgggccagcaactgcgcagcaccgcgaatgccgcccagggggttcttgatctcatgtgccaggccacgcaccagcatcttgctggtttcctgcttggacagttgcgcctcttccttggtgatgcgcagcaatcggtcgcgaggatgcacttcgagcaatagcagggtggcgccgttgctcaggatcggggtcacggcgtagtcgacggtcagggtctggccggtgagggccgtgagcatcgcttcgcgcttggtgaacgggtgcgcctgctccaccgcctggcgcaacgagctcaaggcttcggccgactcggtgaacaactcgctgatgaactgcccatggctgcgctggccgctgatggccaggagcatctccgccgccgggttcatgtactcaaggcgcaggtcggcattgagcaggatggtcgcggtggtcaggttgtcgagtaacaaacggtgcagtgcatcgctgatggtcatcgggacctcttttggagcaaggcgcgggcttgaggcacacgctgatacgaggaaaatgcaaaaaccaaaccaaggctccgaaaagaagcgttaaagccctgaaataggcgtttgtggcgcgaaactgtggcgttctgccagcttgaacgggaagattcgaaccaaaatgggctgtggctggagtgagggtgcaacctatcgcaccaatatagtgcggttttgtgaaggttgttcaggaagctgccagagatggccctgaatgcatacagcccaaatgtgggagggggcttgcagtcattaacctttatagatgcagagttcggcggtggcgcggatcattgccagttggcgcagcggatcgttcagcggttcgtgcacggcctcggccagccactgcggacactgcgggtcggtgcgctgcggggtgaaagcggccaattgctcaagcaggcgcttttgcagttgatccagctgcgggcgaatctgcttgaccaggtccgggcgcggatcgtcaggcgccttgccctggaactgccagtcggacaggtgggtgtattgcaccagtttgttcgcctcgatctgtgccgagaaaaactgctcggcggcggcagggtcaagcttgtagctcggggcttgggcgacgacgctggcgatcacttcctgctcgcgttttttgtcttcgacgggcttgtggctgtcccatttgctcaaggccacctgatcggcaatctccaggcgttcggcgatgctgttgagcagtggctccaaggtaggtggtgcggcgtaaacaccggcgctgacgaatagcagggcgaacacgaatttatgtttcaacgcagatctccttgtgggagggggcttgctcccgatggctgtgtgtcagtaacacacatattgcctgacactctgccatcgggagcaagccccctcccacctttttgattgagtttgcagatttgaagctgcataactcccaggcaaaaaaagacctcccggaggaggtctttttcatcacgccacgttaagcagcgctaccggatcagcagctgtagtacagctcgtattccagtgggtgtacgaaggtgcgaaccttgatttcttcttcgcttttcagctcgatgtaggcatcgatgaagtcgtcgctgaatacgccgcccttggtcaggaacgcacggcccttgtccagctcttccagggcttctttcaggctgccgcacacttgtgggatctctttggcctcttcaggcggcaggtcgtacaagttcttgtcggcggcatcgcctgggtggatcttgttctggatgccgtccaggccagccatgaccagcgcagcgaaggccaggtatgggttggccgctgggtccgggaaacgcgcttcgatacggcgagcgcgagggctggacacgtaaggaatacggatcgaggcggaacggttgcgggccgagtaggccagcattaccggcgcttcgaaacctggcaccagacgcttgtaggagttggtcgacgggttggtgaagccgttcagggccttaccgtgcttgatgatgccgccgatgaagtacagggcagtgtcggacaggccggcataaccttcgccagcgaaggtgttcttgccttctttggcgatggacaggtgaacgtgcatacccgaaccgttatcgccatacagcggcttaggcatgaaggtcgcggtacggccgtaggcatcagccacgttgtgtacgcagtacttcagggtttgtacttcgtcagccttggcaaccagggtgttgaacttcacaccgatttcgttttggccggcagtggccacttcgtggtggtgaacttcgatgaccaggcccatctcttccatggcgttgcacatggaggtacggatttcgtggtcgtggtcgaacggcggaactgggaagtagccacctttgatgcccggacggtggcccttgttgccgccttcgatgtcttggtcggacatccacgaaccctgttcggagaagatcttgaacatggaaccggagatatcggacttgaacttgaccgagtcaaagatgaagaactctggctcaggaccaacgaatacggtgtcaccgataccggtggacttcaggtattcctcggcacgcttggcgatcgcacgtgggtcgcggtcgtagccttgcatggtcgaaggctcgatcacgtcgcagacgatgatcagggttgggtcttcggtgaacgggtcgagcacggcagtgctgtcgtccggcatcaggatcatgtcggaagcttcgatgcctttccagccagcaatggaggagccgtcgaacattttgccttcttcgaagaaagcgtcatccagcgcgtcgcgagccggcatggtcacgtggtgctgagtgcctttggtgtccgtgaagcgcagatcaatccatttaacgtcatgatctttgatgagttgaaccgacttcgacatggtgtcctccgggtggcttcgggctgggtagtggagttagcccttagaatgtgggtgatgccggcgcggatactccgccatggcaacctgcctcacaagagagcaaattgcatgccagtgcgccaacatggccgttttgcctcaaaatggcccctataacggtgcaatccgccaaaacgtaataaatagcgcactgcaatgtagcgttaattgacgcaaatgacccgttttggtgcgttgcacaagcggtgcatattaactggttaaaccttgagcgatttccgctataatccgcgcccccctttttcagcaggcccggcgcgcgctgtttccatgaaattaatcgttaaagtcttccccgagatcaccatcaagagccgaccggtacggacgcgtttcatccgtcagttggccaagaacatccgtgccgtgctccgtgacctggacccggctgtggtggtgaacggcgtgtgggacaatctcgagctggaaacccgtattaccgacgccaaagccttgaaggacatgaccgagcgcctgagctgcatgccgggcatcgcgcatttcctgcaggtggatgagtacccgctgggcgacttcgacgacatcaccgacaagtgcaagcagcactacggcagctcgctggaaggcaaggttttttcggtgcgttgcaagcgtgccggcaagcacccgttcagctccatggacgtcgagaaatacgtcggcagcaagctgcgtcgcgagtgcggcgcagctggaatttccctcaaggcgccgcaaattgaagtgcgcatggaaattcgcgaccaacggttgtttgtgattcacagccagcacgacagcatcggcggctacccattgggcgccctggaacagaccctggtattgatgtccggcggtttcgattccacggtggcggcctaccagatcatgcgccgcggcctgatgagccacttctgcttcttcaacctgggcgggcgtgcacatgaattgggcgtgatggaagtcgcgcactacatctggaagaagtacggcagctcccagcgtgtgctatttgtgagcgtgccgttcgaggaagtgctgggggaaattctcggcaaagtcgataacagtcatatgggcgtggtattgaagcgtatgatgttgcgcgctgcctcgcgaattgccgatcaactgcagatcgacgcgctggtgaccggcgaagcgatttcccaggtatccagccagacgctgccgaacctgtcgatcatcgactgtgttaccgagaagctggtgttgcgcccgctgatcgccagccacaagcaggacatcatcgacctggcagaacagatcggcaccgccgactttgccaagcacatgcctgagtactgcggggtcatctcggtgaaccccaagacccacgccaagcggcatcgcgtggagcatgaagagaaagaattcgacatggcgattctggagcgtgcgctcgagaacgccaagctggtgccaatcgatcgcgtcatcgacgagttgggccaggatgtgcaaatcgaagaagtcagtgaggccctggccggccagatcgtcatcgacatccgtcacccggacgccgctgaagacgagccgctggaaattactggcatcgacgtgcaaacgctgccgttctacgcactgaacgcgcgtttcaaggaactggataacagccgtcagtacctgctgtattgcgacaaaggcgtgatgagtcgcctgcatgcccaccatttgctcagtgaggggcatgccaatgtgcgcgtttatcgaccgagctaagagcccggggctgtttgcctgtggcctgcgtcaccggccccccgactctgccgtcaagctgtaacggcaaggcctgactctactgttaatcgctgccacgacctgtcagcacaccgaatcctctgatcgagatacacaagtgatcgaaaatctacgtaacatcgccatcattgcccacgttgaccatggtaaaaccaccctggtagacaaactcctgcgtcaatccggcaccctggagcgcaacgagctcaacgacgagcgcgtgatggactccaacgaccaggaaaaagagcgcggtattaccatcctggcaaaaaacaccgctatcaactggaacggctaccacatcaacatcgtggataccccgggccacgccgacttcggcggcgaagtagaacgcgtaatgtcgatggtcgactccgttctgctgctggttgacgctcaagacggccctatgccgcaaacccgtttcgtgaccaagaaggccttcgaagccggcctgcgtccgatcgtgtgcatcaacaaggttgaccgtccaggcgcgcgtccggactgggttctggaccagatcttcgacctgttcgacaacctcggcgccaccgaagaacagctcgatttccaggtcatctacgcctcggccctgaacggtattgctggtcttgaccacaacgacatggctgaagacatgaccccgctgtaccagtcgatcgtcgacaacgtaccgccgccgaaagttgaccgtgaaggcccgttccagatgcaaatctcggcactggactacaacagcttcctgggtgttatcggcgttggccgtatcgctcgtggtagcgtcaagccgaacaccccggttgtggctatcggtgccgacggcaagaagcgtaacggtcgtatcctgaagctgatgggtcaccacggcctgcaccgcatcgacgttgaagaggctttcgccggcgacatcgtgtgcgtgagcggtatggactcgctgttcatctccgacaccctgtgccagccagacaacgtcgaggcgatgaagcctctgactgttgacgagccaaccgtttccatgaccttccaggtaaacgactcgccattctgcggtaaagaaggcaagttcgtgacctcccgtaacatcaaggagcgtctggacaaagagctgctgtacaacgttgcactgcgcgttgaagaaggcgactcggctgacaagttcaaagtctccggccgtggtgagctgcacctctcggtactgatcgaaaccatgcgtcgcgaaggcttcgaaatgggtgttggtcgtccggaagtgatcatccgtactgttgacggcgtgaagcaggaaccgttcgaaaacgtcaccatcgacacccctgaagaatcccagggcaaggtcatggaagagatgggcctgcgtaagggcgacctgaccaacatggtgccggatggcaagggccgtgtacgtctggaatacaacatccctgctcgcggtctgattggtttccgtaaccagttcctgaccctgaccaacggtgctggcatcctgacctcgatcttcgatcgttacgacaccatgaagtccggcgacatgtccggccgtcagaacggtgttctggtatcggtagaaaccggcaaggcgctgacctactccctggaaaccctccaggcgcgtggcaagctgttcgttgaacacggtcaagagatctacaacggccagatcgttggtctgaacagccgtgacaacgacatgggcgtcaacccaaccaaaggcaagaagctcgacaacatgcgtgcttcgggcaaagacgaaaccatcgccctggttccacctgttcgcttcaccctggaacaggccctggagttcatccaggatgacgagctgtgcgaagtcacgcctaagtcgatccgcctgcgtaagaagatcctggacgaaggcgagcgtacccgcgctgccaagaaagccaagaactgagttaactcaggctgaatgaaaaacgcccccggtcgaaaggccgggggcgtttttttatgcctgctggttttgtggcgcctgtaccggcctcatcgggagcaagccccctcccacacttgaatgtgttcacaaatcaaaatgtgggagggggcttgctcccgatgaggcccttcaaaacactacaaatcttggatcagaacttatcgagggttttgaaattggtctcgcgcaccacttctttcggcttatacgcgcagtaccccggccgcggcccgattttcgggtggttgcggcaagtatccgggcgcttgtcataaatagtgcagaagcgcgtcttacgatccaggtacaggcagtcgttgttgctcatgcgctgcagggtaaaaatctcggatttgttgttatagcgctcgacgatgccttccttctgcaagcgcttggcgatgttcttcggcgggtcgccgcgctcgaactcatcgacgatgccaatgcggatcaggtccttgatcttcacctccaccggcagggtgcagcagctggatacgcagccgccgcacatgtgggcggaatatttctgccacgtttcgagacggtcgagttccgcggcggcgatcagttgaggcttcatcagggttccaaggtggggcggtgtccgggcgcgcgatcataccgggattgatgattttttgaacaatattttcaggtttttcatcttcggtggcgttcgggcacgacccctgcatctaatccctttaacagtgaatgagttaaaaaactgacgaaccagagccggcgccgtgtgtcagagcgtctaggctctagcaactccttctatctcgcccgaggtcgcaactgatgtctcaggaaccacttgcacgagaagcagaggtagccgcattccgcgatgctgtcttgaccaaactcacctacgcggtgggcaaggacccggatcacgccttcgaccatgactggttcgaagccattgccctggccgctcgcgaccagatggtcgatcactggatggaccatacgcggcgtatttatcgcaaaggccagaagcgcgtttactacctctccctggaattcctcatcggtcgtttgctctacgacagcctgagcaaccttggcgtgctggaaatcgcccgcgaagccttgtccgaactgggcgtcgacctggaacgcattcgcctgctggagcccgacgcggccctcggcaacggtggcctggggcgcctggccgcctgcttcatggaaagcatgtcgaccctgggcattgccggccacggttatggcatccgttatgagcacggtctgttccgccaggccattgtcgacggctggcagcaggaacaaaccgaacgctggctggatttcggcaacccgtgggagtttgaacgcgccgaggtgatttacccgatcggctttggcggcagtgtcgaaactattgcggacgcctccggcaagatgatccaggtgtggtcgcccaacgagaccgtacgcgcagtagcctatgacacaccagtagtcggctggcgcggcgccagcgtcaataccctgcgcctttggcgtgcacgggccgtagaagacttgcacctggagcgcttcaacgccggtgaccacttgggcgccgtcgccgaagtggcccgcgccgaaagcatctcccgcgtgctgtacccggccgacagcaccgaagccgggcaggaattgcgcctgcgccaggaatatttcttcgtgtccgcttcactgcaggatctgctgcgccgccacaagaacatgcacggctcggtgctgagcctgggcgaacacgccgccatccagctcaacgatacccatccgtccatcgccgtggccgagttgatgcgccaactggtcgacctgcatgacattccttgggaagccgcgtgggacgtcaccgtcgaaacgctttcctacaccaaccacaccttgctacccgaagcgctggaaacctggcctgtaggtttgatggagcgcatgctgccccggcacatgcagatcatctacctgatcaacgcccagcacatcgactcgctgcgcgccaagggcatccacgactttgacgtactgcgcgccgtgtcgctgatcgaagaagacaatggccgccgcgtgcgcatgggcaacctggcgtttctcggctcccatagcgtcaacggcgtgtccggcttgcatacccagctgatgcgcagcacggtgttctccgaactgcacaagctttaccccgaacggatcaacaacaagaccaacggcatcaccttccgccgctggctctaccaggctaaccccaagttgaccgagatgctggtggaggccctgggtccggacattctcgatagcatggaaacccgcctgacggagttggaaaccttcgccgagaaacagaccttccgcaaatccttcgccgaacagcgcttgcacagcaagcgtgcactggccgagatcattcatgagcgcctaggcatcgcggtcaacccggcggcgatgttcgatgtgcaggtcaagcgtatccacgaatacaaacgccaactgctcaacctgttgcacaccgtggccctgtaccaggcgattcgtgccgaacccgaggtcgactgggtgccaagggtgaaaatcttcgccggcaaggcggctgccagctaccaccaggccaagctgatcatcaagctgaccaacgacatcgcccgcaccgtcaacaacgacccgaccgtacgtggtttgctcaaggtggtgttcctgcccaactacaacgtcagcctggcggaaagcattatcccggcggcggacttgtcggagcagatatccacggccggtttcgaggcgtcaggcaccagcaacatgaagttcggcctcaacggtgcgttgaccatcggcaccatggacggcgccaacgtggagatgcacgagcgtgtcggcgccgagcacatgtttatcttcggcctcagtgcccagcaggtggaggcgcgcaagcacgcgggtgaattcaatgccgggccggacatcgccgtgtcccaccgtttgagcgacgtgctgcaagcgatccgcggcggggtgttctcgccggatgatccggggcgttatgtcggcctgatcgacgggctgatcgactacgaccgcttcttggtgtgtgccgatttcgattcctactgggatgcccaggcacgggtcgaggcgcattggcatgactccaaggaatggtggcgttcggctgtgctgaatacggcaaggatgggctggttctcctcggaccgtaccatccgcgagtacgccaccgagatctggaaagccctcgactaaacaccgcaacacaaaatgtgggagggggcttgccccctatgacggagtgtcagcattgaatgtatcagctgatccaccgctatcgggggcaagccccctcccacattgcttctgcgtcgatatactggccttcggttcgctcagggaatatcgaccatgcaatggattttcatgctgattggcctggtactcggctgggcgctcgatgagtctttcagcgatgcgggtatcggtgcattgtttgggttgggcatcggccaggcgctccgcctgtcgcagttgtcggcccaggcgcagcagcaggccagtcagttggaaaccacgcagaaggcgctgatagccttgggcgagcgcctgcggcagctggaagtgcccacgccgaccagcaacgttgcagccgacccccctgtgcctgagccgacccctgtcgtcaaaccgtccgaactggtttgggagctgcctgctgaattgacgcctgtggccataattgccgagccgagccggccgctaccggatgacgcctgggcgcctgccgccgcgccacgcgcccccgaaccactgcgcagtcccacgctgttcgaacgcgccatcaccgctgcacgcaattggctgttcggcggcaataccgtgctgcgtgtcggtttggtgctgttgttccttggcctggcgttcctgcttcgctacgccacggaaggcatggtggtgccgatccagctgcggtacgccggagtagcgacggctgccatcggcctgctgggcctgggctggtggttgcggcgacgtaacagtaattacggcctgatgctgcaaggcgccggtatcgcagtgctgtacctgacggtattcgccgcaatgcgcttgcacccgttgatcgacccgggcacggcgtttggcctgttggtggtcgtcaccgttttttccgcgattctggcgctcactcaagatgcgttgggcctggcctgcgcggccgtgctgggcggttttgctgcgccgctcctggcgtctaccggtgccggcagccatgtgacgttgttcagctacttcgccctgctcaatgccggcatccttgccatcgcctggttcaaggcttggcgcccactcaacctgatcggctttgtcggcactttcggtatcggcttcgcctggggtgtgcgtgcctatacgccggacatgttgtggagcactgagccgttcctgattgtatttttcctgatgtacctggccgtaggcttgttgtttgcctggcgcaaattgcacgagatggccgatgcgcccgaggatgacagccgtggcgcatggctgcgctggtcggcggccaagggcgattatgttgacggcagcctgttgttcggtccgccgttagtgggctttgggttgcagttcgcattggtacagcatctggaatttgccgcagcgttcagtgccttggcactgggcattctctacatggccctggcgcgctggctgagcggcgggcgtaccttgttgctggcgcaaacctgcctggcccttggggtgattttcgtcagcctggcgattcccctggggcttgatgcgcgttggaccacggcggcctgggcagtagagggcgccggaatcttctggctcggcttgcgccaacagcggctattggcgcgggcatttgccttgttgctgcagctgggctcggcactggcgtttttcagcgagttgcgtcccggtacagacacgctgctggaggggccggcactgagtgcgttgttgctaggcgcagcgttgctgttcacgttttatcaggctcacaaagctgcgcctgagctcgcccacgcctgggaacgtaaaggcgcaccgtggcttgcggcgctcggcctgggctgtggatatctactggcgccgttgctgtggtcgacccagggcagcgtcatcggctggtcgctcgccagcctggtgacggcgtgggcaggccggcggctcggttcgcagacttgggtgcgttgtgccgtggccgtgcaactgctcagcggcatcagctttgcgctcgaccccgtcagtaatttctacacaccgatgatcattgccctggcagcaatgaccagtgcctggtgtttgcggcatcagcaatcgacccgcagctccaaactgctgctgggctggggcgtggtgtggtgggggctggcggtgctcggcgaagtgtggcgctcagccccgacggattggcacgcgacctggttatacgcggcagcggcactcagcacggggctgtggtgctggctggcgctgcgcctgcgttgggtggcgctcggggcggtgtgcaccttgctgatgccggttgccggtatggtgctgcttggcacatgggacgagtactaccatccggccgccaacctcgccgggttggcatgggtggcggttttcgtgctgcacttcgtttcactgcgccgcctggcgttgctggtgccgcagcaagcgctgagtgttgcccatgtgctcggctgctggatgttgatcggcgtgctgacgctggagctgcgctacggcctgatgcagctgtcgagcgagtacaacgcctggcgctggctgggttgggcgattctgccaagtctgtatctgatgctcgcggcggcaccacgtgcctggccgtggccggtgtcgggctatccgcgtgagtaccgcgtgctggccgcgctacccctggccgcattgatgctggggtggttctggctggcgaatatgttcagcgacggtaccgccaaaccgatgccctacgtgccgctgttcagcccgctggatctgggcctgctgtttgcgttgctcggggtgtacctgtggtcgcgcagcgtggcgccgcaacgcgggtcgcaagtgacattaatcgcccaggcggtggtgggtgcctcgttgtttgctttctttaccgcgctggtgatgcgcaccgcgcaccattggagcggtgtgccgttccatttggatgcgctgctggagtcgatgcgggtccaggcagggttgtcgattatttggaccctgatcgccctcggcctgatgatcggcggtcacctgcgccatcgtcgcgaagtatggctggtcggtgcggtgctgattgcggtggtggtggccaagctgttctttgtcgagttgagtaaccgcggcggcctggcgcggatcgtgtcgttcatcggcgtgggtgggttgctgctggtggtggggtatttcgcaccgctgccgcccaagcgggctgagcctgcgggcaggccttgaactctattggagttaaatcctctgattagaggaaatacacctcgactcgcgctaaactgcgcgggttttcagccccccattctccggagccgtccatgtcccgcgttaccctgagtcgctatttgatcgagcagacccgcagcaacaacacgcctgctgatctgcgcttccttatcgaagtggtggcgcgtgcttgcaaggaaatcagccacgccgtatccaaaggcgccctcggtggcgtgctgggcagcatgggcactgaaaacgtgcagggcgaagtgcagaagaaactcgacgtaatctccaacgagatcctgctcgaagccaacgaatggggcggtcacctggctggcatggcgtccgaagaaatggacaatgcctaccagatcccgggcaaatacccgaaaggcgcgtacctgctggtattcgatccactggacggctcgtccaacatcgatatcaacgcaccagtcggcaccatcttctcggtactgcgttgcccaagcgaatacctgagccagaacgaagccctgaacgaaaaggccttcctgcagccaggcactgagcaggtggctgccggctatgcgatctacggcccacagaccatgttggtgctgaccctgggcgacggcgtcaagggcttcaccctcgaccgcgaaatgggcagctttgtgctgacccacgaagacatttcgattcctgcctctacccaggaatttgcgatcaacatgtccaaccagcgtcactgggaagagccggtgaaacgttacgtcaacgagctgatggaaggcgaagaaggcccgttgaaaaagaacttcaacatgcgctgggtcgctgcgatggtggccgacgtgcaccgtatcctgacccgtggtggcctgttcatgtacccacgcgacagccgtgagccatccaaaccgggcaaactgcgtttgatgtacgaagccaacccgatgtcgttcctggtcgagcaggcgggcggtgcgtccaccgatggccaccagcgtatcctcgatatccagcctgagggcctgcaccagcgcgtggcggtgttcctgggttcgaaggaagaagttgagcgtgtgaccggctaccacaagaagtaatacacggcgataaattatccgccgtgttgtgaggccgttcacccttgaagaagccccgaaacgtttcagcgtttgcggggcttttttgttttcgctcgtcgggaaccagacacctcttttcccttctaagcttctggcagataccccagctgctttgtctctccaggagcttttccatgtctttacgccgtctcgccctgctggctttttgcgtgctgttagccgcttgcagcaaggtcactcaagaaaactaccagaaattgtcggccggcatggccaaggccgaggtagagtcgttgctgggcaagccaaccgattgttccggcgcactgggcatgtccagctgcacctggggcgataaaaacagctttatcagcgtgcagtacgccggtgacaaagttctgatgttttccgggcaaggcctgaagtaaaccggggcgcgagcctgcgggagaagaagaatgatgcgttttgttttgttcctttgcgccagcctgtttttggcgggctgtgccagccattctggcgatgatctgcaacccaagactgcgagcaacgtcaacctcaagcgttaccagggcacctggtatgagttggcccgattgcccatgtacttccagcgcaactgcgcgcaatccgaagcgcgctataccttgctgccggacggtgacatgtcggtgttcaatcgctgcctgacacctgaatggaagtggcaggaggccaaaggcacggccacgccgcaagtgcccggcaagaccgacaagctttgggtcgaattcaataactggttcacgtcactgctgccgggcgtcgccaagggcgattactgggtgctgtatgtgagcgatgactacaagaccgccatcgtcggcagcccgagccggcgctatatgtggatcctgtcgcgcacgccgacggtgagcgccgatacccgcgaagacttgctcagtagggcgcggcagcaggggtatgacaccacgcggttgatctggcgtacttcagataaacaaatggccaagacttcgcagtaattaaatgtgggagggggcttgctcccgatgcagtgtgtcagccagtacatctggtactgacacaccgctatcgggagcaagccccctcccacatgtgttaggtgttggccgttagcccaacaaagccttcaagacctgggtgaatgcccggttgctttcctcttcaccggcatgccgcccatcccgcaccacccacttgccattgaccagcacatcgcgcacctgccgatcaccgccggcgaacaaccagcggttgagaattgcgtcctcggtagctgtggccaggtacggatcgttaccgtccagcacgatccaatccgcacgcttacccacttccaagcgaccaatcggctggcccagcgcctgtgcgccaccgtccagcgcagcatcgaacagcgtgcgcccaaccatcggctggtcactgcgatacaggcgattacgccgttgatcgcgcaggcgctggccgtattccaaccaacgcagttcttccaccacgctcagtgatacatggctgtcggacccgatacccatgcgtccaccctgggcgaggaaatccaccgccggaaaaatcccatcgccaaggttcgcctcggtggtcaggcacaaaccggcaatcgcccggctcttggccatacgtatcacttcatcggggtcggcatgggtggcgtgcaccaggcaccagcgttcatccacctcgacattgtcatacagccaccgcaatgggcgcttgccgctccaggccaggcagtcgtcgacttctttttgctgctccgcgatatggatatgcaccggacaagtcttgtcactggcggccaggacgtcgtggatttgctgggggatgacggcgcgcagagagtggaaacacagtcccagtcgctgcgcgggttgtgccgccaggatcggctgcaagcgtgcttgcaggtccaggtagttttcggtgctgttgataaaacggcgctggccttcattcggcgcctggccgccgaagcctgagtgggtatagagcaccggcaccaacgtcaggccgatcccgctgctggcggccgccaggctgatctggcgcgacagctcggtacggtcggcgtagggctggccgctgacatcgtggtgcacgtaatgaaactcggccaccgaggtgtagccggccttgagcatttcgatatacagctggcgggcgatgacctgcaattgctcggggctgatcttgccgaccatgcggtacatcaggtcgcgccacgtccagaaactgtcattggggttgccagccacttcggccagacctgccattgcgcgctggaaggcatgggaatgcaggtttggcatgcccgccaataccgggcccctgagccgttcggcagcgtctgcactggcattgggctcaacctgggtcagcaggccatcggcgctgacttcaagacgtacatcgttggcccatccattaggcagcagcgcgcgttcggcaaagaaagcggacatgatcaaggcaccccggtcgtgtgtttatttgtatatacatatacagacgtttgcctgctcggtaaactccggcaatctatgcatcttttcttcctgcaaggattccctgtgccgactccgcccgccaagtcttcgctggctgcccacatggacgaaagtccggcgcccttgtatgcccgcgtcaaacagatgatcagccagcagatcctcaacggcaactggccgccccattaccgcgtgccgtcggagagcgagctggtcagccagttgggcttcagccgcatgactatcaaccgcgcactgcgcgaactgaccgccgaagggatgttggtgcgcatgcaaggtgtgggcacgtttgtcgccgaaccgaagagccagtcagcgctgtttgaagtgcacaacattgccgatgaaattgcctcccgcgggcatcggcacacgtgccaggtcatcaccctgggcgaagaagccgccggttccgagcgtgccgtggccctggaaatgcgcgaaggcgggcgggtgtttcattcgttgatcgtgcattacgagaacgacattcccgtgcaaatcgaagaccgtttcgtcaacgccctggtcgcgccggactacttgcagcaggacttcacccagcaaaccccatatgcctatttgaatcaggtcgcgccattgaccgagggcgagcatgtggttgaggcgattcttgccgacgccgccgagtgcaagttgttgcagatcgagccgagcgagccgtgcctgttgattcgtcgccgcacctggtcgggtcgccagccggtaaccgctgcgcgcttgatccatccaggctcccgtcacagcctcgaaggacgtttcagtaaatgagtgaaatcaaggtctggcgcgccgccgactacgtacgcatgccgtggaaaaacggtggcggcagtaccgaagaaatcagccgtgatgcgggcgctggcctggatgggtttggctggcgcctatcgattgccgatattgccgagtcgggtggtttctccaccttcgccggctaccagcgtgtgatcacggtgatcaaaggcgcgggcatggtactgaccgtggacggcgaggagcagcgtggtttgttaccgttgcagccgttcgcgttccagggtgaaagccaggtgtcctgccgcttgatcacggggccgatccgcgacttcaatctgatctactcgcctgagcgttaccatgcgcgcttgcagtggattgacggtgtacagcgattcttcagcacggcgcagacggtgctggtgttcagcgtggcggatgaagtgaaggtgttgggcgagaagctcggccatcacgattgcctgcaagtagacggtaatgttggcctgctggatatatcggtcaccggccgttgctgcctgatcgaactgaccgcacgcggttaaaaaatgtgggagggggcttgctcccgatagcggtggttcagtcaattgataggtgactgataaaccgctatcgggagcaagccccctcccacatttgttttgtgtgatccatagatctgtttccagcctgcgcaccaatttgttacttaatgccccagcgtgacgcaaagctgcgctgtcgtgacaaatccctcttgccgtaaaacatctccgtaagaaatttcatcaagcttcgaagcctttattttcaaggcatttgctcgtcttcggaaaaaatcttcagggctcactccaagagttggccgctcgattgcatatgcttgtacatacaagtaaagatgtgtgcgtaagactctccttcgcaccatccatgttcgcgcatcgatcgccgaggagtcctagcagtgaccaagtctacaaaataccgtgacgtcgaaatccgcgccgcccgcggtaacaagctcaccgccaaaagctggctgactgaagcgccgctgcgcatgctgatgaacaacctcgacccacaagtggccgagaacccgaaagaactggtggtgtacggcggtattggccgtgcggcgcgcaattgggagtgctacgaccaaatcgtcgagagcctcaccaacctgaacgacgacgaaaccctgttggttcaatcgggtaaaccggtcggcgtgttcaagacccacagcaatgccccccgcgtgctgatcgccaactccaacctggtgccgcactgggccagctgggaacacttcaacgaactggatgccaagggcttggccatgtacggccagatgaccgccggcagctggatctacatcggcagccagggcatcgtccagggcacctacgaaaccttcgtcgaggccggtcgccagcattacaacagcgacctcaccggccgctgggtgctcaccgccggtctcggcggcatgggcggggcccagccgctggcggcaaccctggctggcgcctgctcgctgaacatcgaatgccagcaggtcagcatcgatttccgcctgagcagccgttatgtcgacgagcaagctaccgacctcgacgacgccctggcgcgcattgccaagtacaccaaggaaggcaaggctatctccatcgccctgctgggcaacgccgccgaaatcctgccggaactggtcaagcgtggtgtacgtccggacatggtcaccgaccagaccagcgcccacgacccgcttaacggctacctgccagccggctggacctgggacgaataccgcgcccgcgccaagaccgagcctgccgccgtgatcaaggccgccaaacagtcgatggccgtgcacgtcaaagccatgctggaattccagaagcagggcatcccgaccttcgactacggcaacaacatccgccagatggcccaggaagaaggggtggaaaacgccttcgacttcccgggtttcgtaccggcctatatccgcccattgttctgccgtggcatcggcccgttccgttgggctgcactgtccggcgacccgcaggacatctacaagaccgacgccaaagtcaaagagctgatcccggacgatgcccacctgcacaactggctggacatggctcgcgaacgcatcagcttccagggcttgccggctcgtatctgctgggttggcctgggtcagcgcgccaagctcggcctggccttcaacgaaatggtacgcagcggcgagctttctgcgccggtggtgattggtcgtgaccacttggactccggttccgtatccagcccgaaccgcgaaaccgaggccatgcaggacggttccgacgccgtatccgactggccgttgctcaacgccttgctcaacaccgccagcggcgcgacctgggtctcgctgcaccacggcggtggtgtgggcatgggcttctctcaacactccggcatggtgatcgtctgcgacggcaccgacgaagcggctgagcgaattgcccgcgtgctgcataacgacccggcgaccggggtgatgcgtcatgccgatgccggttaccagatcgctattgattgcgccaaggaacagggcctcaacctgccgatgatcaacggctgacgcacccactgtaggagcgagcttgctcgcgaaggtattccaggcgcatcgctgcgttgaatgtacgtttttcgcgagcaagctcgctcctacagaaaagcatcgaacaatccatcagaggttgaaccccatggctgcgaatgacaccaccccgttgatcgaaaggcgctcgatcgactatatcccggaagcggaaagacacggtcgtctattcagccagttcaccctgtggatgggggccaacctgcaaatcaccgcgattgtcaccggggccctggccgtggtgctgggtggtgatgtgttctggtcgttgatcggcctgctggtcggtcaactgattggcggcggcgtcatggccttgcatgcggcccaaggccccaagcttggcctgccgcagatgatttccagccgggtgcagttcggcgtgtatggcgcggccatcccgatcgtgctggtgtgcttgatgtacctgggtttcactgcaaccggcaccgtgctgtcgggtcaggcgctgggacagttgtttggggtcagcgacagtgtcggcatcctgattttcgccagcgtcatcgtgctggtcaccgtgctgggttatcgggtgatccatttcatcggccgtatcgccagcgtcattggcgtgattgcctttgtctacctgttcagtcgcctgatgagccagaccgacgttggcgcacttctgcagatccgccatttcagctggagcagttttctgctggccgtgtcgctcgcggcatcctggcagatcgctttcggcccgtacgtggcggattattcgcgttacctgccgagcaggacctcatcggtgaaaacctttctcgccgctggtgcaggttcggtcgtcggtgcacaggtggcgatggtccttggcgtgtttgccgcggcgatgtccaacgggcagttcgccggtcacgaagtggcctacatcgtgggcctgagcggtacgggcgccaccgctgcattgctgtacttcagcatcgcgttcggcaaggtcaccatctccacgctcaactcctacggcagcttcatgtgcattgcgaccatcatcagcggctttcgtggccgcctggaggtcacgcgtatgcaacgcctggtgttcgtgctcgccatcgtcggtacggcaaccctgatcgccctgctcggccagcactcgttcctcggtgcgttcaagtcgttcatcctgttcctgctggcgttctttacgccctggagtgcgatcaacctggtggattactactgcatcacccgcgagcgctatgacgtgccggcactggccgacccgaacggccgctacgggcgctggaacctgctgggtatcagcgtctatgtcttcggcgtgctggtgcagctgccgttcatcgccaccaagttctacaccggccctttggtggccgcgctgggtggcgtggatatttcctggatcatcggcctggtactgccggcggccctgtattacgtgtgtgcgaaaaaatggcacggcacggtacccgatcacctgatcctgccaaaagagtagggcgctttacccacaacaaacgggctggctgcacaggcctgatgggacgtggacagggcaggacgcctactgactgccgtaatccatttcatgattgggagcgtcacaacaatgactatgaataagaccttgctggctaccttgttctcggctggcttgctggcaagcgccggcgcccaggcggccggctggtgcgaatccggcaaaccggtgaaattcgccggcctgaactgggaaagcggcatgttgctcaccgacatcctgcaaaccgtgctggaaaaaggctacgactgcaaaaccgacagcctgccgggcaactccatcaccatggaaaacgccctgggcagtaacgatatccaagtgtttgccgaggagtgggtaggccgcagcgaggtctggaacaaggccgagaaggccggcaaggtcgtgggcgtcggtgccccggtcgtcggtgcggtcgaaggctggtacgtaccgcgttatgtgatcgaaggcgacgccaagcgcaagctggaagccaaggccccggacctgaaaagcatcgccgacctggccaagtacgcctcggtgttcaaggaccaggaagagccctccaagggccgtttctacaactgcccggccggctggacctgtgagctggacaacagcgaaatgctcaagagctacggcctggaaagcacctataccaacttccgcccgggcaccggcccggcgctggacgcggcggtgctgtcgagctacaagcgtggcgagccgatcctgttctactactggtcgccgacgccgctgatgggccaggtcgacctggtcaagctggaagaaaagcccggtgtggataaaagcgtgaccatcaaggtcggcctgtccaagactttccacgaacaagccccggaactggtggccgtgctggaaaaggtcaacctgcccatcgacctgctcaaccagaacctcggccgcatggccaaggagcggattgagtcgccaaaactggcgaaaattttcctcaaggaacatcctgaagtctggcacgcctgggtgagcgacgacgcagccaagaaaatcgaagcggccttgtaggtcaagtgtgcgcggctaccctcaagggtggctgggcggctggccacaacccactggatcgagagcactatatgtttcctgagagttttacgttttccatcgccgactgggtcaacggttgggtggactcgctggttaccaactacggcgatgtgttccggcacatttccgacaccctgctatgggccatcgtcaacctggaagggttgctgcgcatggcgccttggtggctgatgctggccatcgtcggcggcgttgcctggcacgccacgcgcaagctggtaaccacggcagtgatcgtcggtttgctgttcctggtgggcgcggttggcctgtgggataagctgatgcaaaccctggcactgatgatggtcgccacggtgatttcggtgctgatcggtattcccctgggcatcctgtcggcgcgcagcaatcgcctgcgttcggtgctgatgccactgctcgacatcatgcagaccatgcccagcttcgtgtacctgatcccggtgctgatgctgttcggcctgggcaaggtaccggcgatcttcgccacggtgatctacgccgcgccgccgctgattcgcctgacggatctgggcattcgccaggtcgatggcgaagtcatggaagccatcaacgcctttggcgccaaccgctggcagcaactgttcggcgtgcaactgccgctggcgttgccgagcatcatggccgggatcaaccagaccaccatgatggcgctgtcgatggtggtgattgcctcgatgatcggcgcccgtggcttgggcgaagacgtgcttgtcggcatccagaccctcaacgtcggccgtggcctggaagccgggctggcgatcgtgattctcgcagtggtcatcgaccgcattacccaggcttatggccgcccacggcatgaggcgagcaaatgactactgtcagcaaaatcgaagtaaagaacgtcttcaaaatattcggcgcgcgttccaaggatgccctggccatgatcggccagggcaagaccaaggaccaggtactggccgagaccggctgcgtggtcggcgtgaatgacctgtccctgagcatcggcactggtgagatcttcgtgatcatgggcctgtcaggttccggtaaatccaccctggtacgccatttcaatcgcctgatcgaccccaccagcggcgcgatcctggtggacggcgaagacatcctgcaactggacatggaagcgctgcgtcaattccgccggcacaagatcagcatggtgttccagagctttggtctgttgccccacaagagcgtgctcgacaacgttgcctacggcctgaaagtacgcggcgaaaccaagcaggtgtgtgccgagcgcgccctgcactggatcgaaaccgtaggcctcaagggctacgaaaacaaatacccgcaccagctttccggcggcatgcgccagcgtgtgggcctggcccgggccttggcggccgacaccgacatcatcctgatggacgaggccttcagcgccctcgacccgctgatccgcgccgagatgcaggaccagttgctcgagctgcaaaagaccctgcacaagaccatcgtgtttatcacccacgacctcgacgaggccgtacgcatcggcaaccgcattgcgattctcaaggacggcaagctgatccaggtcggcacgccgcgggagatcctgcattcgccggcggatgagtatgtggatcgctttgttcagcggcgggcggcggtggtctgagccgggatttgtggtgaggctgcttgccctatcgggagcaagccccctcccacattttgaactgtgaacacctttaaaggtgggagggggcttgctcccgatggggccgctaaggctgcacaagaattgaagaaggtatgaagatgccccaggcaacaacaatcatcatcgccgacaccccgatgcgctggcaggacgtggccgccgtggctcgccatggcgccgtgctcgagctctcgggccaggcctgggcgcgcatcgacaacgcccaggccatcgtgcaacgcatcgtcgccagcggcgagcgcgcctacggcgtcaataccggcctgggcgccttgtgcaacgtgtcgctcaaagacgagcaactgagccagctgtcgcgcaatacactgctgagccacgcctgtggcgtcggcccggtgctcagcgacgagcagacccgcgcaatcatctgcgcggcgatcatcaactacagccacggcaagtccggcctgcatccgcaggtggtgcactcgttgctggcgctgctcaatcacggcatcaccccacaagtgccgtcccagggttcggtgggttacctgacccacatggcccatgtcggcgtggccttgctcggcgtcggcaatgtgagctatcgcggccaggtggtcacggcgcaacacgctttgcaggctgaaggcttgcaccccgtggtgctcggcgccaaggacggtctgtgcctggtcaacggcacgccgtgcatgaccggcctgagctgtttggccctcgccgatgctcaccctatgctgcaatgggccgatgtgatcggagccatgagctttgaagcacagcgtggccagatagatgcttttgacgaagaaatcatcgccctcaagccgcacccgggcatgcagcaggtaggcagcaacctgcgcgccttgctcgacggcagcgaagtcatcgccagcagcaaaggtattcgcacccaggacgccctgagcatccgctcgatcccgcagatccacggcgccgctcgcgatcagcttgagcacgccactcgccagatcgagactgaactcaacagcgccacggacaacccactgctgcttggcacgccggataactatcgcgtggtatcccaggccaacccgcacggccagtccgtagcgctggcggcggacatgctggcgattgccatggccgaaatcggctcggtggccgaacgccgcctggaccgcctgatcaacccgcacgtcagcggcttgccggcgttcctggtcagtaaccccggggtcaactccgggatgatgatcgtgcagtacgtcgccgcatccttgtgcgggcagaaccgccaactagcgcaaccggcggtgctcgacaacttcgtcacctcgggcctgcaggaagaccacttgagcatgggcaccaacgccgcgctcaagctgcaccaggtgctggccaacgtcacccagatcctcgccatcgagtatctgctggcagcccaggcgttcgaattcctcaaggaccagcgcttcggcgtgggcaccgaccacgcctggcgcttgttgcgcgaagtggtccccgcttacgagcaggaccgttggctggcgccggatattgccgccgctgcccagttgcttaaagaaactgcgttaccgaatttgcactgaacacctaagaataattcacaaggagaacgaatgtgactgcgctaaacctgattccaggccaactgaccctcgcccagctgcgggccatctaccagcagccggtaaccctcagcctggatgacagcgcctcggcccagattgaagccagcgtcgcctgtgtggagcagattctcgccgagaaccgcaccgcttacggcatcaacaccggtttcggcctgctggcctcgacccgcatcgccagtgaagacctggaaaacctccagcgttccctggtgctgtcccacgccgccggcgtcggtgagccgatcagcgatgcgctggtgcggctggtcatggtgctcaaggtcaacagcctcagccgcgggttctccgggatccgtcgccaggtgatcgacgcgctgatcgcgctgatcaacgccgaggtgtacccgcacattccgctgaaaggttcggtcggcgcctctggtgacctggctccgttggcgcatatgtccctggtgctgcttggcgaaggcaaagcgcgttacaagggcgagtggctggaagccaccgcagccctgaaagttgctggcctcacaccgctgaccctggccgccaaagaaggcctggccttgctcaacggcacccaggtatccaccgcttacgcattgcgcggcctgttcgaaggtgaagacctatttgctggcgcgctcacctgtggcggcctcaccgtggaggccgtactgggttcacgctcgccgttcgatgcgcgtattcatgcggcgcgtggccagcgtgggcagatcgatgcggctgcggcctatcgtgacctgttgggcgaaagcagccaggtgtcgcagtcgcaccagaactgcgacaaggtccaagacccgtactccctgcgttgccagccacaggtcatgggcgcctgcctgacccagttccgccaggctgccgaagtgctggtggtggaagccaacgcggtgtcggataacccactggtatttgccgccgaaggcgatgtgatttccggtggcaacttccacgccgaaccggtggccatggccgctgacaacatggccttggccatcgccgaaataggttccctgagcgagcggcgcatctcgctgatgatggacaagcacatgtcgcaactgccgccgttcctggtaggcaatggtggggtgaactccggtttcatgattgcccaggtcactgccgctgcactcgccagcgagaacaaggcattgtcccatccccatagcgtcgacagcctgccgacctcggcgaaccaggaagaccacgtctccatggccccggccgcgggcaagcgcctgtgggaaatggccgagaacacccgtggcattctcgcggtggaatggcttgcagcgtgccagggcctggacctgcgcgacggcttgaaaacctcgcctgcgcttgaaaaggcccgggacatgctgcgcgacaaagtagcgttctacgacaaggaccgcttctttgccccggacatcaatgccgccagcgaactgcttgccacccgttgcctgaatgagctggtgccggccaagttgctgccaagcttgtaagcacgaccgccttcactgtaggagcgagcttgctcgcgaaaatcgccaacgattacgcggtaaacctgacatccatcagcgctctcaggtttttcgcgagcaagctcgctcctacaggtgaggtcgcgtttttctcaggataagaataatagggaagagaaatgcaccaacaagaaaagggtttgaaacgcgggctcaatgcccgacatattcgcttcatggcgctgggttccgcgatcggcaccgggctgttctacggctctgcctccgccatccagatggccggccctgccgtgctgctggcctacctgatcggcggcgccgcggtgttcatggtgatgcgcgccctcggtgaaatggctgtgcacaatccggtgtccggctccttcggccagtacgccagcacctacctggggccaatggccgggtttatcctcggctggacctatgcgtttgaaatgatcatcgtctgcctggccgacgtcaccgccttcggcatctacatgggcttctggtttcctgaggtcgcccgttgggtctgggtgctgggcatcgtgtttttgatcggcggccttaacctgtgcaacgtcaaggtttttggcgagatggagttctggctgtcactgctcaaggtcggcgctatcgtggcgatgatccttggcgggtttggcatcatgctgttcggcattcattcggcgggtgaaacccatgccagcggcttgagtaacctgtgggcccacggcggcttcatgcccaacggtatcggcgggctgattgcctcgtttgcggtagtgatgtttgcctttggcgggatcgaaatcattggcatcacggccggcgaagccaaggacccgcagcgggtgatccccaaggcgatcaacgcggtgccgctgcgcatcctgttgttctacgtgctgaccctgttcgtgctgatggcgatctacccatggccgcagatcggcagccagggcagcccgttcgtgcagatcttcagcaacctgggcataggctcggcagcgaccatcctcaatattgtggtgatctcggcggccgtgtcggcgatcaacagcgacatcttcggcgctggccgcatgatgtacggcctggcccagcaagggcaggcgcccaagggttttgcgcagttgtccaggcagggcgtgccgtggatgactgtagtggtgatgggcgcagcgttgctcggcggtgtggtgctcaactacctgatcccggaaaacgtgttcctgctgatcgcgtcgattgccaccttcgccaccgtgtgggtgtggctgatgattttgttcacccaggtcgccatgcgtcgctccatgaccaaggaacaggtcgccgagctgaaattcccggtaccgttctggccctatgcgccggcagcggccattgtgttcatgctgtttgtgtttggcgtgctcggttacttcccggacacccaggcggccttgatggtcggcgccgtgtggatcgtgctgctgatcctcgcttacttgctgtgggtcaaacccgccgccgggcaaacggccagggtccactacgacccggccttgtctcatcgataacttagggaggcgttgatgaaaaccctttggcaccattgccacgtcgcaaccatggcccagggcaaatactcgatcatcgaggacgccgccatggtgactgtcggctcgctcatcgagtgggtcggcccccgcagccaggcacccacggtggattacgcccaggtgcatgacctgcaaggcgcgtgggtcacccccgggctgatcgattgccacacccacacggtgttcggcggtaatcgcagcggcgaattcgagcagcgcctcgaaggcgtcagctacgccgagatcgcggccaagggcggcggtattgccagcaccgtgcgtgccacccgcgctgccacggaagatgaactgtttgccagcgctgaaaagcgcctgcgcagtttgctgcgtgacggcgtgaccacggtggagatcaaatccggctacggcctgaacctggccaacgaacgcaagatgctgcgcgtggcccggcgcctgggcgaagcgctgccggtcagtgtgcgcgccacgtgcctggccgcccatgcgttgccgccggaatacaaagaccgcgccgacgcctacatcgagcacatctgcaccgagatgctgccggccctggctgcagaagggttggtggatgcggtggacgccttctgcgaatacctggcgttttccccggagcaggttgagcgtgtatttaaagtcgcccagcagctgggcctgccggtgaagctgcacgccgagcaactttcgtccctgcacggttcaagcctggcggcgcgttaccacgcgctgtcggcggatcacctggagttcatgaccgaagacgacgccatcgccatggctgctgccggcaccgtcgccgtcttgctaccgggggctttctacttcctgcgtgaaacccagttgccaccgatggaggccctgcgcaagcacggggtgaagatcgccattgccagcgacctcaaccctggcacctcgccggcgttgtcggtgcgcctgatgctgaacatggcctgcaccctgttccgcatgaccccggaagaagccctggccggcgccacgcagcatgcggccactgcgttgggcatgggcgacacccatggttcgctggaggcgggcaaggtcgctgactttgtcgcttggcagattgatcgccctgccgacctggcctactggctgggcggcgaactggataaacgcgtcgtgcgccatggcgtcgatgtcactgtttaaggagctctgttgtggataaggtcctgacattcaaacaaggccgcgtaccgctgctgatcagcatgccccacgccggcctgcgcctgacgcctgcggtcgaggccgggttgatccccgaggcgcaaagcctgccggacaccgactggcatatccccttactgtacgactttgccgaagaactgggcgccagcaccctggccgcggagtactcgcggtttgtcatcgacttgaacaggccctcggataacaagccgctttatgcaggcgccaccaccggcctgtacccggagacgctgttcgatggcgtgccgttgttccgtgaagggcagacgccctccgaagaagagcgcgcgagctacctgcaaaagatctggggtccttatcaccgccagctgcaagaggaactggcgcgcctcaaggccgagtttggctacgcgctgctgttcgatgcgcactcgatccgctcggtgatcccgcacctgttcgacggcaagttgccggacttcaacctcggtaccttcaacggcgccgcatgcgatccggaactggccagccagctcgaagccatctgcgccgcgcatccccagtacacccatgtgctgaacgggcgtttcaagggcggccacatcacccggcactacggcgacccggcgcaggatgtccatgccgtgcaattggagttgtgccagagcgcgtatatggaggagtttgagccgtttcgctatcgtcccgacctggccgaaccgacccaggtggtgttgaagcaactgctgcaagggtttttgtcttgggggcaaagccggtaccgatgattcagggtgttgctcaaatagctatcgggagcaagccccctcccacattttgactgcattcacacagtccaaatgtcggaggggctggaggggtcgactgtaggattatctgcggagcgaactgctgacacaggtctaagtgctcaaggacatgctcattgcacaattcgggtttatgatgcctgacggcaaaataatagacgtccccccagggatgaacccgacaccctacggagcgcgcaatgcagacttggtacccgcagatcaaaccctacgcccggcatgatctggctgtcgatgacacccacaccctgtatgtcgatgaaagtggctcccccgaaggcttgcctgtcgtgttcatccacggtggcccaggtgccggttgcgacgcccagagccgctgctatttcgacccgaacctgtaccatattgtgaccttcgaccagcgtggctgcggtcgctcgaccccgcgtgccaacctcgaaaacaacaccacctgggatctggtcgccgaccttgagcgcatccgcgagcacctgggcatcgacaaatgggtactgttcggtggttcctggggctcgaccctggccctggcctacgcgcaaacccatcccgagcgcgtgcttggcctgatcgtgcgcggcatcttcctcgcccgcccgcaggacatccactggttctaccaggagggtgcgagccgcctgttcccggattactggcaggactacctggcgccgattccggtggaagagcgccacgacatgatcgccgcctaccacaaacgcctgaccggcaacgaccagatcgcccagatgcatgcagccaaggcctggtctggttgggaagggcgcatgcttggcctgtgcccgagcccgcagcatgtcgagcgcttctccgagccgcagcgcgccttgtccattgcccgcatcgaatgccattacttcaccaacaactccttcctggagcccaaccagctgattcgcgatatgcacaagatcgctcatctgcccggcgtcatcatccacggtcgctacgatatgatctgcccgttggataacgcctgggagctgcatcaggcctggcccaacagcgagctacaggtgattcgcgaggccgggcacgcggcctccgagccgggtatcaccgacgctttggtgcgagcgaccggcgaaatggcacggcgcctgcttgatctgccccctgaagaagcatgaagggcctgttgcagcgggtgcgtggcgcccgcgtcgaagttgccggggaggtcgtgggcgcgattgaccagggtttgctggtgctggtcgccgtcgaaccttcagatacgcccgagagcgccgacaaactgttgcacaagctgcttaactatcgggtgttcagcgacgacgagggcaagatgaacctgtcgctcaaggatatcggcggcggtttgctgctggtgtcgcagttcaccctggcggcggatacaaaaagcgggctgcggccaagtttctccacggcggccccaccggccctgggagcggcgctttttgagcacttgttgttacaagcgcaacaattgcatggcaaggtggcttcagggcgttttggcgccgatatgcaggtgcatttggtcaatgatggccctgtgaccttcctcttacagacatgaatgtattaaaaacgactttaatgctgaaaaacgcaggttttcgctacaaatacttcactgtccctgatgcgttgtctcgcgggctactagataatcgcgcgctacggggatcagcgttgtttggtccatttttgacttaggtagagacttgtccgatagcctttggggaatcatttggccctaggggagtcggaacattgctcgccaacctggcatatagatagctggccgttggttttttgatctgttttcggcgagggttgctcgtgattgttagtccctgtaatgcaccaaaattgtctgccaaacggttacgaaacgcactggtgacgggctctgccctgttttgcctgttcggcgcgggtcaactgtgggcattcagtctggatgatgtgtcggccaaggcaaaagagctggccgggcagaaatacgaagctccgcgcagcaatctgccgaacgaattccgcgaaatgaaattcgctgactaccagaagattcgtttccgcaatgaaaaagccgagtgggccgatcagaacaccccgttcaagctgtccttctatcaccagggcatgcatttcgacacgccggtgaaaatcaacgaagtcactgccgacagcgtgcatgaaatcaagtacgacccgacgcgtttcgatttcggcgacgtgaaattcgatcccaaggccactgaacagctgggttatgccggtttccgtgtgcttttcccgatcaacgaggccgacaagcaagacgaaatcatgaccatgctcggcgccagctatttccgcgtcgtgggcaaggaccaggtatatggcctgtctgcccgtgggatggccattgataccgcacttccgtccggcgaagagttcccgcgttttaccgagttctggatcgaacgtccaaaaccgggtgacaagcacctggtgatcttcgccctgctggattcgccgcgcgccactggtgcctatcgcctgatcctgcgccctggcaccgacaccgtggtcgatgtgaaatcgcagatgtacctgcgcgacaaggtcagcaagctgggcgtggccccattgacctcgatgttcctgttcggcgccaaccagccgtccaaggtcctcaactaccgtcgcgagctgcacgactccagcggcctgtcgatccatgccggcaatggcgagtggatctggcgcccgttgaacaaccctaaacacctgtcggtcagcaacttcagcgtcgagaacccgcgtgggttcggcctgctgcaacgtggccgcaacttcagccactacgaagatctggacgacaactacgacaagcgcccaagcgcctggatcgagcctgaaggcgattggggcaagggctccgtcgacctggtagagatcccgactgccgatgaaaccaacgacaacatcgtggctttctggagcccggccgaactgccggaagtcggcaagccactggacatcgcctaccgcctgcactggaccctggacgacgcggcattccactcgccggagagcgcctgggtcaagcagaccctgcgttccaccggtgacgtgaaacaatccaacctgatccgtcagcccgatggcagcgtggcctacctggtggacttcgagggcccgtccctgaagaaactgctgccggacgccccggtgcgcagccaggtgagcgtgggcgataacgccgagctggtcgaaaacagtgtgcgctacaacgagcacaccaaaggctggcgcctgaccctgcgcatgaagatcaaggacgccggcaagccgaccgaaatgcgtgcggcactggtgcaggatatcgtgcagccagagcctgagccggtttccacccatgtattgaaagccgacaaagtcttggccaagcagcacgagaagcaggccaagaaagacgcgaaagacaagcaagcccagcagccagaagctgccccagccactccggagccgatcaagaccgagcaagtcctgaccgaaacctggagctatcagttgcctgccgatgagtaattcccaagtcacgcccgagactctgtccgagtacctggcgcatctgcccatgacggccgagcagcgcgccgagctggcgggctgccgctcgttcagcgagttgcatgagcgtctgtcgtcaaaaaccttcgacgcaccgaccgacgccgcccaggcctcggtcggccgtcgcttgaccctcagcactgccgaagagctgcaagacgccgaaatgctggcgctcgacgccagcggtcgcgtatgcctcaaggccacgccgccgatccgccggaccaaagtggtgcccgagccttggcgcaccaatatcctggtgcgtggctggcggcggatcaccggtcgcaccaatccgcccaagccaccgaaagacgagcgggtgttgccggctgcgcgctggcgtaccgtgggttcgatccggcgctatatcctgctggtgctcatgctcggccagaccatcgtggctggctggtacatgaaaggaatcatgccgtaccagggctggtcgctggtcgacttcgacgaaatccgcaaccagaccctgctgcaaacggcaacccaggtactgccctacgccctgcaaaccagcatccttatcatgttcgggattctgttctgctgggtgtcggctggtttctggaccgcgctgatgggcttcctcgagctgctgaccggtcacgataaataccgcatctccggtaaaagtgccggcgacgagccgattccgaaggatgcgcgcaccgcgctggtgatgccgatctgcaacgaagacgtgccgcgtgtattcgcgggtttgcgtgcgacgttcgagtcggtggccgccaccggcgacctggatcgcttcgatttcttcgtgctcagtgacagtaacgaggccgacatctgcatcgccgagcagcaagcctggctcgatgtgtgccgcgaggccggtggcttcggcaagatcttctatcgccgccgtcgccgccgcgtaaagcgcaagagcggcaacctcgacgacttctgccgtcgctggggcggtgactacaagtacatggtggtgctcgacgccgacagcgtgatgagcggcgagtgcctgaccagcctggtgcgtctgatggaagccacgccggatgcggggatcatccagaccgcgccacgggcgtcgggcatggacaccctgtatgcgcgcatgcagcagttcgccacccgcgtttacggcccgctgtttaccgccggcctgcacttctggcagctgggtgaatcccactactggggtcacaacgcgatcatccgcatgaagccgttcatcgagcactgcgccctggcgccgttgcccggtaaaggcgcgtttgccggtgcaatcctttcccacgacttcgttgaagctgcgctgatgcgccgtgccggctggggcgtgtggattgcctacgacctgccgggcagctacgaagagctgccgccgaacctgctggacgaactcaagcgtgaccgtcgctggtgccacggtaacctgatgaacttccgcctgttcctggttaaaggcatgcatccggtgcaccgtgcggtgttcctgaccggcgtgatgtcctacctgtcggcgccgttgtggttcttcttcctggtgttgtccaccgcgttgctggcggtgaataccctgatggaaccgcagtacttcatggctccacgccagttgtacccgctgtggccacaatggcatccggacaaggcggtagcgctgttctccaccaccatcgtgctgctgttcttgcctaaactgctgagcatcatcctgatctgggccaagggcgcgaaagagttcggcggcaagttcaaggtgaccttgtcgatgctgctggaaatgctgttctccatgctgctggcgccggtgcggatgattttccacacgcgtttcgtgcttgccgcgttcctcggatgggccgccacctggaattcgccgcagcgtgacgacgactccacgccatggagcgaagcggtcaagcgccacgggccgcaaaccctgctgggcttcctgtgggccctgctggtggtgtggttgaacccaagcttcctgtggtggctgatcccgattgtcggctcgctgatgctgtcgatcccggtgtcggtgatttccagccgggtcaagctgggtctcaagtcccgcgacgagagcctgttcctgatccctgaggaatacaatccgccgcaagcgttgctgtcgaccgagcaatacacccatgaaaaccgctggcacgccctcaatgacgggtttgtgcgttcggttgtcgacccgcagcagaacgccctggcctgcgccttggcgacctcccgtcaccgtgaggcagagccgatcgagtacctgcgcatggaacgtgttcgccacgcgttgaaagtcggcccggccggcctcaacaacagtgagcgcctggccttgctcagcgaccccgtggccctggcccgcctgcatgagcaggtctggagcgaaggtcacgccgagtggcttggtgcctggcgtgcatcgatcaaggctgatccgcatgcgccgttgctgccgctgcaaccgcagtcggcccaggctcaaccggcctgattcagacgcccccgagggctcgcctcgggggtgttccaaacgctggtcctacagcgtttacagttccttctttgcatcgctaactccttgttatttcgaaacaaaagacctttgttcgaagcgtattgccgtgcctgtagctgggttagcatcgccccccaaaatttgactcgccacgggggcatccatgatcaagaagtactgtgcggcattgctgattagctgtttcctattggtacacactgggctgctgaaggcgggtgcgctggacgatgctgttcgccgtggtgtgctgaaagtaggcacgactcccaattacgtaccctttgaaatgcttgataagcaagggcgcatcatcggctttgaaatcgacttgcttcatgccatgagccgtgcgatgggcgtaaagcttgagctggtggcggtgccctataaggagctgctgccggggttgatggcgaaaaagtttgatctcattggcagcggcatgactgtcacccaggagcgcaatatgaaactcaatttcagcgactcgttcatcgtggtgggccagtcagtgcttttgcatcctcgcctggcgagtgcggtttccagcattgaagacttgaaccaagccggttatcaagtcgtctccattgaaggcaccacaggagaggccgcggcacggcgctttctcggggcggcgcgtctcacgactgtgacgaccccggaagagggggtgcggcaggtcgtagacggtgaggttgacgcgtttgtgcatgacgcgccctacaacctgatcgcgatgaaccggccgcagaacagcgcattgctggcactggagcaacccttcaccttcgagcccctggcctttggcttgaagaaaggtgattacgacagcctcaactggatcaatcacttcctcaaccagatcgcccaggacggcacctacgatcgcctgcatgacaagtggttcacggacactgcctgggtgtctgagcttgagtgatcgtcataactacttacacatcaatcaattgcccagccgctgcgccgatgtgtctacctctgcattgaactgcaacgctgtcggggttttccgacatacgccgatatgatttacccgtgaaacctttgtgacggacaacgagtgggttaggatcgcaccccgaaatggcgcagccctttgcgcgccgaccttataagaatcgttcaggggacttgttgatgaaaaagtatctttcgatgctgctgctcggtgtcactgcgctggtcgctgccacggcggcacaggccggtgccatcgacgatgcggtcaagcgcggcacgctgaaagtcggcatggacccaacctacatgccgtttgaaatgaccgacaagcgcggtgagatcatcggtttcgaagtcgacatcctcaaggccatggccaagtccatgggggtcaagctggagctggtttctactggctatgacggcatcatcccggccttcctgaccggcaagttcgacatgatcggcagcggcatgaccctgacccaggagcgcaacctgcgcctgaacttcagcgaacccttcatcgtggtcggccagacgctgctgatccgcaaggacctggaaggcacgatcaagtcctacaaagacctgaacgacgagaaataccgcctgacctccaagctcggcaccaccggtgaaatggtggccaagaagctgatctccaaggccaagtaccacggctatgacaacgagcaagagggtgtgctggacgtggtcaacggcaaggccgatgcctttgtatatgacgcgccgtacaacgtggttgccgagaagaaagtcggcaacggcaagctggtgttcctggaagagcccttcaccttcgagcccctggcgttcggcttgaagaagggtgactacgacagcatcaacttcatcaacaacttcctgcaccagatcaagaacgacggcacttacgatcgcatccatgacaagtggttcaagagctccgagtggctcaaggacatggaataaaagcttgacggtgtaggagcgagcttgctcgcgaaaatcgtcaatggtaacgcggcaatcctgacacccaacgggttctcggatttttcgcgagcaagctcgctcctacaaaagcactgcatccggaaaatgaaatgaaacagaaaaaagcccaatggccctggcacctgctcaccgtggttgtgctggtcggcctggctggcgccttgtactacgccacctcgctgatgtcctacgagtggcgctggaaccgcattccgcaatactttgcctatcaagccgagacctcccaacgcgctgcggatatgtccaccgtggtcgagttggtgcgcaaaggcgacatggccgaagtcaccctgcgcaatgacgcggggggcgagcaaaagctcacggttgccgacaacagcctgcaagtggcccgcggcgacgatgtggctgagggcgatgtggtcggcgtgactcgccagtgggcgctcgggccgttgatgtggggcttgtggaccacgttgtggctgtcggtggtgtccggcgtcctaggcttggccattggcttggcgaccgggttgtgccggctctccaaaaacccgaccttgcgcgacctgtcgacgatctacgtcgaactggtgcgcggtacgccgttgctggtgcagatcttcattttctatttctttatcggcacggtactcaacctatcccgggagtttgccgggatcgccgcgctgtcgttgttcaccggcgcctacgtggcggaaatcgtccgcgccggggtgcagtccatcacccgtggccaggacgaagcggcgcgttccctgggcttgagcgccagccagtcgatgcgccatgtggtgttgccgcaagccttcaagcgcgtgctgccgcccctggccgggcaatttatcagcctggtaaaagacacgtcgctggtgtcggtgatcgcgattaccgagttgctcaagagtggccgcgaggtgatcaccacctcgttctcgccgtttgagatcctgttctgtgtggcaggcctgtacctgctgatcaacctgccgctgtcgaaaatggccagccggcttgagcggaggctcgcccaaagtgattgaagtgcgcgatctggtaaaagtcttcgatacccgtgggcacgtggtgcgcgcggtggatcatgtcaccacccaggtcgccaagggcgaagtgctggtggtgatcggcccgtcgggctccggcaagtccaccttcctgcgctgcctcaacggtctggaagaattcgactcgggctcggtgagcatcgacggcctgcaactggccgaccctaagaccgatgtgaatgcctaccggcgtgaagttggcatggtgttccagcatttcaacctgttcccgcacatgaccgtgctggaaaacctgtgcctggcgcaaaaggttgtgcgcaagcgcggcaagcaagagcgcgaggccaaggccctggccctgctggaaaaggtcggtatcgcacagaaggcccatgagtttccgtcacgcctgtctggcggccagcagcagcgggtcgcgattgcccgggccctggccatggagcccaaggtgatgctgtttgacgagcccacctcggccctcgatccggaaatggtcggtgaagtgctggacgtgatgaagaccctggccctggaaggcatgaccatggtctgcgtcacccacgagatgggctttgcccgggaagtggcggaccgggtgctgtttttcgaccacggcaaactgctggaagatgccgcgcccgccgccttcttcgccgctccccaggacccacgggcacaagccttcctgcgccaggtgctgtagccgctcagaccttgaagcggcctaccgaacgcgccagctcggagcccaggcgtgccagttcaacactggctgccgccgtctgctcactggccgtcgaggtttgctccgacgcttccttgaccttcagtacgctgcgattgatctcctcggccactgcgctttgctcctcggccgccgcggcaatctgcgggttcatttcctggatcaccgagaccgtgcgggtgatgttggccagcgcctgacctgcgcgacgcgtcagttccacactgttgtcggtcaggctgaggctgttgtccatgatgtcggcagtgtgttgtgtgccccgctgcagcccctcgatcaacccttcgatttcctcggctgattgttgggtacgctgggccagggtgcgcacctcgtcggcgaccacggcgaaaccgcgacctgcctcacccgcgcgtgccgcttcaatagcggcgttgagggccaacaggttggtctgctcggacaccgacttgatcacctccagcacgctaccgatcttctggctttcctgttgcaggccttgcattgcctcgcttgagcggttcatttgctcggccaggtgctcgatatgggtaatcgcctcggccaccacctggtcacccacgcccgcttgttgatcagcctcggtggcggcaatcgaggcttgctcggcatggcgtgcgacctcttgggaggtggcgagcatttcattcatggcggtggcgacctgttcggtttccagtttctggccattgaccccggcgcgggtttgctcggtgacggcggacaattgctcggcggcgctggcgatctggcgggcgctgtcggtgatgccaccgatcagcgtgcgcaggttcagggtcatttggccgatgctgcgctgcaattggcccagttcatcgcgccgtgacgtggtgatgtcgtggctcaggtcaccctcggctatacggttggcggtttgcagcgcctgacgcagcggcctgacgatctgaccggcgatcagccaggctgcgagggcgccgagcagcagcgctgcgccggttacatagagcatcagcaggcgcgccaggtcggcttccttgtcgcgttgctgggtctgctcctcgctcaaccggtcgctttgcgacagcagttggtccagccactgctccagttggttctggacggtttcaacggtgacctgcgcctccttgaggcgatcgagttgggcgcgataatcgagcaaggcactgttcagcgcggtgctgtctaccggcagcgccgtcacggcagactgggcgccgtcgagggttttgagcgcagcatccaccgcttgcgtgtagagctgcagtgtgtcggcggcccaggccggggacttggcgcggtcttcggctgcctccatggcctggcgcaggttttctacgctgtccagggctttctcgtcattctggtcgggcaagtcgctggacagttgtccaagggtgtcactggcgttcacggagctgttggtgagccgtttctgcgcttgctcgcgttgctccatcagattgggcagaccggccagtgccgtcttgaagcgtgcgctgaggcggctggaatcctggacttgctgcaggtgcatggggatcttcaggcggtcggtcaactcgaccagataaccgtcgattttctccatgtgccggccgagtttgtcaaagcttgccgggtcattcacgacgcggtacacaatccggtcggcgcgcaattcttcgccggtcacggcgaggcgcgaaagggtggtcaaggtttgagcgcgaaacagcgaggcgttcagggcctgccatcccgtcagggcgacagccatgcacagcgccagtaccaggccgaagccaaggatgagtttgagggtgacgctggtgttgcctaatacgcgggtcagtggtcgaaacatgatgcacctccatcagaaaagagagcgcttcgcaccccggctgacgcaggtcaggaggagtgagaacgctaaatcttttcggcatagggcgcgtaagaattgacctgaaagacgtgtaggaaatttcataagttgcaggcggcccaggacgggccgccaccagggtgggatcaggtcagacccggaagcggccgaccaaggcttgcagatgagtgcccaggcgcgccagttcggtactcgaggcggcggtctcttcgctggctgccgccgtttgctcggagatatcgcgcacattcagcacgctgcggttgatctcttcggctaccgcactttgttgctcggcggcggtggcgatctgtgagttcatcgcctggatggtcgagacggtgcgggtgatattgcccaacgcattcccggctcggcgcgtcagctcaacgctgctttcggtcagcccacggctgttgtccatgatggccgccacctgctgtgtgccgctttgcaggccgacgatcaactcttcgatctcctcagtggacttctgcgtgcgctgggccaggctgcgcacctcatcggccaccacggcaaaaccgcgcccggcctcaccggcacgcgccgcttcaatggctgcgttgagggccagcaggttggtttgctgggccacggacttgatcacgtcgagcacgctgccgatcttgtcgctttcgcgcttcaggtcgcccatggcgaccgtggagttgccgacctcggtcgccaggcgttcgatctgggcgatggcttcaccgaccacctggtcgccttcacgggcctgctggtcggcggccacggcggcttcggacgcctcctcggcattgcgcgccacttcctgcacagtggcggccatttcgttcatggcggtagccacctggtcggtctcgactttctggctattgaccccggcgctggtctgctcggtcaccgcggacaactgttcggccgcgctggcgatctgggtgacaccctcgctgataccgccgatcaactcgcgcaggcccacggtcatgctctgcatggcgcgttgcaactggcccagttcgtcctgacgggcggaatccagattgtggctcagatcgccggaggccacgcgctcggcgactttgagggtctggttcaggggaatgacgatctggcgagtaatggcccaggcagcgagcacgccgaagatcagcgccagtacggtggcgagcaatagccaatatttggcctgggcggcatcgtgatctcgcacggcggtttgcgatgtggtgagtttgtcactgtggcccagcaggatgtcgccttgggtggtcatgattttcaacgccgccgcactggccacctgggcgtcgcgatactggctgactgcagcgcggtaggcttgcagtgaaacacctgcttcttgcaggttggcctggtactgcgccggcacctggccttcgagttcagtgactttcttcagggcgttgtcgatggcgtccagggccggctgctcggcttcgaccttgccgctgtaggtgtagccgcgtacttggaagcgcgcttgctggatcagcttgctcaggtcgacgacgctattgaattggatgacgctgtcgccttgcagcagggctttttcaacttcgttgatcttggccacggcgttgtcggcggtatcgccgagcttgctgcgcgcgccctcacgcttgaggcccgcctggaccatggcggtgaaagcttttttatactggttcaaggcttccagctgttgttcgaccaaggctttatcgtcgggttgctcaatcagctcggcggcggttttcaaaccgctgtccaattgggcgagcaggccgtcgaccgcgtcggtgccttgttcgccgcggcgcatttcgaagtccaggcgcgccaggcgcaggtctttggtcaggccgttgaggctggagatgaagcccagcttgtcgccgcgactgatcacgtcacccaggccggtccagccggtaaaggtgatcaacagcgtcaggatcaacaccaggccaaagccgacgctcagcttgcggttgacgctgacattccccagtttctcggctaaccaacgatacatgctgcgaactcccctggaacaaggcttggacttatccagaggctatcggcatgggcgcaggtttctgtagctatgcatatctgatggggaaggatgcttccccactttctgtaggagcgagcttgctcgcgagaaacccatgggcgccgcgtttatccagaagacacgcgttatcgttgacgtttttcgcgagcaagctcgctcctacagtggatcgcgagcattttattagaacagtcgggcaagcagggcggtgacggcggtttcaacgcgcaggatacgcgcacccagttgcaccggctgcaaaccggccttggtcagcagctcgacttcatagggaatccaaccaccttccgggccaatcgccagcgtcaccggctcatccagtccccgggggcacgcaggataatcaccgggatggccgatcaggcccagggtgccttcaaccatggccggcaggcgatcttcgacaaacggcttgaagcgtttttcgataatgatctcgggcagtaccgtgtcccgcgcctgttccaagccgaggatgagttgctcgcgcaccgcctcaggctccaggaagggggtctgccagaagcttttttccacgcggtagctgttgaccagcaccaccttcggcacgcccatggccgccaccgtttgcagcacccggcgcagcattttcgggcggggcagggctagcagcagggtcaggggcagtttgggcggcggcgattgatcgaagctgacttgcagctcggcttcaccgacgtccaggcgcagcagttgggcattgcccatcagcccaccaatgcggcccacacgcaggtagtcacccacaacggcgcggtggacttcctgcatatgcaccagacgccgatcacgcagcaccacccggtccgccgcgataaagtcggcatcgagaagcagcagcaggttcacggctgggtcgctggtggctggtcgtcgtcggcagcctggtcatccgggtgttcgccacgcttgctgatcaagccgctgaacaggatgcccacttcaaacagcatccacatcggcacggcgagcaaggtctgggagaagatgtccggcggcgtgaggatcatgccgaccacgaagcagccgatgattacgtacgggcggatcttcttcaggtacttgacgtcgactacgccgatccataccagcaacaccacggccacggggatttcgaaagcgacgccgaaggcgaagaacagtgtcatcacgaagtcgaggtagctggtgatgtcggtcatcatctccacgccggccggggtggcagcggcgaagaacttgaagatcagcgggaacaccaggaagtacgcgaaggccatgccggtgtagaacagcaggatgctcgacaccagcaatggcacggcgatgcgcttctcatgcttgtacaggcccggggcgataaagccccagatctgatgcaggatcaccgggatcgccaggaacagcgagaccatcatggtcaacttcaacggcgtcaggaacggcgacgacacatcggtggcgatcattgtcgcgccgacgggcaagtactggcgcaacggcgtggaaacgaaggtgtagatctgctgggtaaaggcgaacagcccggcaaaaatgatgaagattgccgctacgcaacgcagcaggcgggtacgcagctcggagaggtgcgagaccagtggcatgtgctggtcgttttccggtttatcagcgctcatggggctcgcggcggcaatgtagggtcatggggcgcgggcgacgcaacgggcgtcggcgcgggctctgtcggagcgggctcggcagcgggggcgggcgcgatactgtggtcggccaccggtggtgtagccggcttggccggttcttgcaccggggagagaatcttgcgtgcctcctgctccaacgacaggatatgttcgttgtgcaattgccggcggatctcgtcggcaccgatttcccgttcaacctcctgtttgatcgcgttgaaactgcgtttcagacgcccgatccacaggccggcggtgcgtgcggcgccgggcaggcgttccggccccagtaccagcagggccaccaggccgacgagcagcagttcagagaagctgataccaaacattagtcagtgctcacgagtctttgcgggtcgtctcttggactttttcagcctgcacgtcgaaggtgcgacgttcggtgatcggctgggtggcctgcgggtgtacaggctgggccgggggcaccgggtttaccgttggctcggctggtttttcgtcgtcgttcatggctttacgaaagcccttgatcgactcaccgacgtcggtgccgaggtttttcagtttcttggtgccgaacaccagaacaaccaccaccagaatgacgatccagtgtttccagtcaaaaatgcccatgctgcaaatcctcaagtcttagttattcaggcggacgggcgcgaggccttctcggcgtgcccggacaggccgaagcgacggtccagttcatccagcacggcctgtggatgctgccccagttgggcgagcatgaccaggctatggaaccacaagtcggcggtctcatagattacatcgctgcaatcaccgctgatttgcgcgtccttggccgcaatgatggtctcgacggattcctcgccgagtttttccagaatcttgttcagacccttgtggtacaggctggcgacataggagctgtcggcatccgcgcctttgcggtcttccaacacctgggccacacggttcagggtatcgctcatgttcaatgtcctgcgggataaatggcgtgcgggtctttgagcaccggttccacgactttccattcgccgttctcgaacacgcgataaaagcagctgtggcgcccggtatggcaagcgataccaccgatctggtcgaccatcaggatcaccacgtcggcgtcgcagtccaggcgcatctcatgcaggatctgcacgtgcccggactcttcgcccttgcgccacagtttgccacgcgaacgtgaccaatagatggcgcgctgctcagtggcagtgaggctcagggcctcgcgattcatccaggccatcatcagcacgcgcccggtcttgtagtcctgggcaatggccggcaccaggccgtcactgtcccacttgatctcgtccagccagtctttcatcttcggctccggcaatttgcgacagtgtataaccggattggctatcgacgcacgatcagataaacgcccacggctaccatgataccggccggccagtggcccagttggttcaatggaccgccaattgccagcatcgcgccgcccacaaggtgcgcggcgcccagcaggcgcaggaaccagtcgtctttgcgtttgcgccacggcggctcggggtctttggcatggggctgggacatacgctcgagcaggtcgcgggtcatgttggccaggtgcggtagctgttcgaactggctgtgcaggttgcccagcatggtcttcgggctcatccgctcgcgcatccagcgttcaaggaacggctgtgcggtgttccacaggtcgaggtccgggtacagctggcggcccagcccctcgatgttcagcaaggtcttctgcaacagcaccagctgcggctgcacttccatattgaagcgccgcgcggtctggaacaggcgcatcagcacctggccaaaggaaatatcctttaacggtttttcaaagatcggctcgcataccgtgcggatcgccgcttcgaattcattgagcttggtttccgccggcacccagcccgaatcaatgtgcaactgcgccacgcgccggtaatcgcgcttgaagaaggcaaacaggttgcgcgccaggtaatcctggtcttccggggtcaggctgccgacgatgccgcagtcgatcgcgatgtactgcgggctccacgggttgacggtgctgacgaagatgttgcccgggtgcatgtcggcgtgaaagaagctgtcgcggaatacctgggtgaagaagatctccacaccgcgctcggcgagcatcttcatgtcggtgcgctggtcggccagggtagcgaggtcggtaacctgcacgccgtagatgcgctccatcaccagcactttcggccggcaccagtcccaatacacttgcggcacgtacagcagttgcgagccttcaaagttacgccgcagttgactggcgttggccgcttcgcgcaaaaggtcgagttcgtcgtagatggttttttcgtagtcggcgaccacatccaccgggtgcagcaggcgtgcgtcggcggagaagcgttcggcggcgcgggcgaggatgaacagccacgccaggtcctggccgatgatcggcttgaggcctgggcgaatcaccttcaccaccacttcttcgccggttttgagctgcgcggcgtgcacttgtgcgaccgaagccgaggccaggggctcgacgtcgaagcggctgaacacttcgctgatcttcttgcccagctgtgcttcgatcagcgccatggactgctgcgaatcgaacggcggcacgcggtcttgcagcagcatcagctcgtcggcgatatcttcgggcagcaggtcgcggcgggtcgagaggatctgcccgaacttgataaagatcggccccaggtcctgcagcgccaggcgcaggcgtgcaccacggctcagctccagctgcttgcgcggcaaccagcgccacggcagcacgtaacgcaccgccagcaagaaccacggcaggggcagggcaaacagcaggtcatcgaggcggtagcggataacgacgcgctggatacgaaacaaacggcggacggcgagcagcttcatgcgttatcgcttggatcaagggagcggctcaggcgttcgaagcgggcctcgaggcgttccaggtcgattttggccttgtcgagctcacgaaagcgcgcttgcgcttcccgttgcccgaccagggtgcgcgattcttcgctcaggtattcggcgaggttctggttgaggctggcgaacccttgctggtaccagcgcgtgcggctgcgcaggtgcccgctgatcagttgggtggccacggggccgatccagcgcgacagttcgtattcccagtccagctccaagtcttgcagcacagcggccaggtccatcagcaccgcactgtcgccttccagctccacctcggggctgtggaggatggcggtcttgttgcggctcaaagccaggtgcaacaggctggaggccggtgcacgcaaggtgcagtcagcttcggcggcccattgggtggcgagaagcaggccttcatcgctgggcaggataaatagctgcatggcggggctgcggcagtcgacggcaatgactttgccgttcaagtgcgcgagccgcgccagggcggtgctgtccaggcgcagcacacggttaaggccgtgttcaacgctggcgagaaggccttgaagcaacatcagggcttgatgccgcggtgcagggcgacgatgcccgaggtcatgttgtggtaggtcacgcggtcgaaaccggcttccaccatcatcgacttcagggtctcctggtctgggtgcatgcggattgactcggccaagtagcggtagctctcggcgtcgttggtgatcaacttgcccatcagcggcatgaaggcgaacgagtaggtgtcgtagaccttggacatcagcgcgttggtcggcttggagaattccagcaccaacaggcgaccgcccggcttgaggacgcgcagcatcgagcggatcgcgtcttctttatgggtgacgttgcgcaggccgaaggcgatggtcacgcagtcgaaatgattgtcggggaacggcagcttttcagcgtcggcctggacgaattcgatattgccggccacacctttgtccagcaggcgatcgcggccgaccttgagcatcgaaccgttgatatcggccaacaccacctggccggtggggccaaccagcttggagaacttggccgccaggtcacccgtacccccggcgatgtccagcacgcggttgccggtgcgtacgcccgaaagctcgatggtgaagcgcttccacaggcggtgcatgccgccggagagcacgtcgttcatcaggtcgtacttggccgccacggagtggaacacctcagcgactttttccgctttctggctttccgggacgttcttgaagccgaagtgagtggtgggttcggcatcgctgcctttgcgctgatcagtcatatcgctgtcaccaaaagagaatgcgggacatgataatccccaaggcctgctttgtcttggcaaggctgcaggtaagataggcgctcaccgagaccttttgccgcatggcgggtgttctgagtcgttataaagaggagtcattgcaatggcccgtattaccgttgaacgtgaacattccctgggaaaagaacaggcgcgggcaaaggccgagcaattggcgcgcaaactcgaggataaatatggcgtggagtcctcatggtctggcgataccctcaagctcacgcgctccggggtcaaaggcacggtggcagtggccgatgattcattgcgtatcgatgtggaactgggcctgttgatgtcggccatgagcggtacgatcaagtccgaaatcgagaaagccctggataaagccctggcctgagcctgatgttcttagggtgccgattctaattttaaaccctactttgtgcccaagccctcaactcctgcgggcggtcctcccccctattttgtgtgaggtgcaccatggccaaagttattttgcagaaaaaaatcgacgttcaggccactaccctgagtgaggttaaaagctatgcccgtaagatttggctggcaggtcttggtgcctatgccaaggttggcagcgagggcggcgagtacttcaaggagctggttaagagtggtcaacgtgttgaaagtaaaggtaaaaaagttgtagttgaacaacttgatgctgccaacagtcagattgaccaagtaaggagtaatgtctccagcgtcaaaggccgggttgaagttcaactggataaagttgaaaaagcttttgatactcgtgtcggcagtgccttgaatcggatcggcattgcgtctaaacatgacgtggagacactctctgctaagctcgaagagctgacggcattgctcgaacgtgtcgcgcgtaaacactaaggagacatcgggatggctgttaaaaagactactcagaaagaaggcagctcgtgggtcgggaaagttgaagaatattcccgcaaaatctggctcgctggtttaggcgtgtactcgaagatcgacagtgacggcagcaaactcttcgagaccttggttaaagacggcgagaaggccgagaagttgaccaagagcacagtgggtaaaaaagtggacgctgccaaggccagtgcgggttccgccaagtcgagcatttcggatacgtggggcaagttggaagagactttcgacaagcgcctcaacagtgctatttcgcgactgggcgtgccgagcaaggctgagttgaaaacgctgcacagcaaggtcgataccctgaccaagcaaatcgaaaaactgacgggcgccaaagtggctccagcgaagacggcggcggccaagcctgctgcaaaacctgcggttaaaacagctgctgcaaagcccgctgttaaaacggttgccaagcctctggctaaagctgcagccaaacctgcggccaaggctccagccaaagccgccgccaagccagccgctaaaacagctgccgccaaaccggccaccaagcctgccgccaagccagtggccgctaaagccgccgccaaacctgcggctaaaccggctgccaaggccgctgcaaagcctgccgcgaaacctgcgactgctaaatctgctgccaagccatccgctgcgaaaccagcagccaaaccagcagcagccaagccggccgctaaacccgcggccgccgccagcaagaagccagcggcagcaaaaaaaccagcagcaccaaaacctgccgctgcggcatcaaccgcttcgacagccaactcggtgtccgcaccgacccctgctgttgcgaccccgactgctacctcggcaaccccgccgacatccagtcagtcctgatctttcaggacaaaaaaatgcccgacctgcagaggtcgggctttttttatggcgggcttatcaataccccaggttcactccgtggtatccaggtacttgagtgcaaaccgctctgtcgcctgccgcgccgtcggcagcaaatgcggggccaccagcatcatgacctggtagaccaccacctgcacctcgccctcacggtcgagaatccgctggtaatccagggaaaacagcagggtgagggtgatctgctccaccagttgccccaacgcctgggtgccgctgaccaactgccctgaggctttcaagcgcgcaagcaaagaggccagtgtgcgtttaagcgcggtgagcaggtggcgaatccccttggccagcttcggcaagcgcccggccaggttcgacaggtcctggaacagaaaccgatagtgcgccatgcgctcgactatcaggtgcaggaacagccagtaatcctcggcctccagttgcgcgtcggcgggagggtcgagcaaaggcgccaactcgccttgaaagcgctcgaacagcccgagcaccagcggctccttgccgtggaagtggtagtagaggttgccggggctgatccccatttcattggccacctccatggtcgacacgttcggctcacccttctggttgaacagctgcagggcacattcaaggatacggtcgcgggtcttcatccagtcttcttaatctgatcgttgagctcagcgcacccgcacgtaagtgcctggggctgcttccatcggtggataattctggttgcccagggcggtgagggtttcgcgcaatacaccggagcgctcctgtgcccacgccagccactgcggccaccaactgccttcgacgtgctgggcgtcgtagtaccaggcgcgagggtcgctgctcagcttgaggttttcgacgtagttggccttggggttgcccggcgggttgaggatgctctggatatgcccgctgttggacagtacaaagcgccgctcgccgcccagcaactgggttgagcgatacaccgcgtcccagggcgtgatgtggtcgttgatcccggccacgctgaaactgtccaccgtgactttgcgtaggtcgatgggagtgccacacacctccagcccgccgggatggctcagcgggttgtgcttgaagaagtccagcagatcgccgtgcaaggcggcaggcaggcgtgtgttgtcgttgttccagtacaggatgtcgaaggccggcggctccttgcccaacaggtaattgttgatccagtagctccagatcaggtcgttggggcgcatccaggcaaacaccttggccatgtcacggccgtccagcacgccttgctggtaggagcggcgcttggcggcttccagggtctgttcatcggcaaacaaggtcgcggggctgtcgatctggctgtccagcaggctcaccaggtagctggcgctggagatgcgccgcaactggcgcttggcttgcaggtggccttgcagggcagctatggtcaggccaccggcgcaggcgcccatcaggttgacctcgcgggcgccgctgatcgcccggcagacgttgagcgcttcttcaagcgctgccacgtaggtggagaggccccattcgcgatgacgcacatccgggttgcgccaactgaccatgaacgtctgcagcccgtttttcagggcgtattgcacaaaactgttggccgggctcaggtcgaagatgtagtacttgttgatttgcggcggcaccaccagcagcggcttggcgtactgtttttcgctcatgggcttgtactggatcaactccagcagctcgttgcgaaacaccaccgagccgggcgtggtcgccactgtcttgcccacttcgaaggcatgcttgctgacttggcgcggcaggccattgttgtgcaacaggtcttcgaacaggttgctcacgccgcgcaccacgctgttgccaccggaattgagcagttccttgatcgccagcgggttaagcagggtgttggagggggagactgcatcgttgagcagggaaaaggcgaaatgtgcgcgggcacggtcatcggcgctcagggtgctgtcatcgatccagtgccgtgtctgtttctgccaactcagataggcctgtaagctgcgccggtatagcgggttgagcgtccaggtgggatcgataaagcgcgcgtccctggggttgggttcctgcacggtttcgcccagcagcacgcggcccaattgaccgcctagcgccaagacatggcgggcggtatgtacggggttacgcaaaccatgggcagccacgctgcgcagggtcgacagcagatcgcgtcccctgaggccggtgatcgcgttttgcgcgttgatgaacgcagcagggatgggcgccggggtcgtcacgggtctttctcgcatgattcaacactccttggtcaagtcatcaagcaggcacgccaatccagaaccatagctggttcctggcaagttgcgcgttggtgtggtccttcacaccgccggtcgcggatgtatcacagcgcgcaggcgctcctcctcgagaaatttcatgatgatcggtgccacggcttcggcccgcgtgatcaggaacaggtggccgtcatcgataatgtgcaactgcgcattcgggatgcgccaggccagcatgcgcatgttgatcagcgggattagcggatcatcgtccccggccagcaccagggtgggctggcggatcttgtgcagccaatgaatgctggtccagcccaacccggcgaacagctgccagtagtaacccagcttgccggccgagcgcactttgctcgcatgttcggcggccaggttcgaatcgcggcggaacgagccgccataaatcatcggcgcgatacgcaccacatgggagggttggatataacgccgggggctggccatcagccacagcactttgggtttgcccggcaccataaaggcgccggctgccgtggccgccaggatcagcttcttgcagcgttccggataatcataggcaaactgctgcgccagtgcgccgccccaggacacacccacggcgttcacctggccgtagtccaggtaatcgagcatgcgtgcggtaagtttggccaggcccggaaagcggtagggccggttcggcgtcgatgagccgccgacaccgggcacgtcgaaggcgatcacttccaggtccgggtccagggcctggacgaacgggaacaccagctcaaggttggcgccgatgccgttgaagatcagcagcggcgtcaagtgcggtttgcccgggcgtaccgccgtacggatggtctggccatccaggtcgatggtacggaagatgaacgattgcggcatgctcaagccctgtgaagtgttacaggaggaatacagtcaaaatgtgggagggggcttgctcccgatggcggtgtgtcattgagcacaactgacactgatccatccctatcgggagcaagccccctaccacatttggatctcattccaatctaccgctcatgtacataggtacctggcgccgcttcggctgcggcatagattttatttcctaatgtcgccggtgctttcttcaatttgcccgcccgctgcgcctgccacgcctgccagtgcagccaccacgaatcggtgtgcttggtggcgttctcctgccactccagcgcgctgcccgacaaaccctcgctggtctggtagcgcgccttggggttgcccggtgggttgaggatgctctggatatgcccgctgctggacagcacaaactcgacctggccgccaaacaactgcgccgacttgtagcaggactgccacggcgtgatgtgatcattggtgcccgccagtgcgtagacatcggcggtgacctgcttgaggtcgatgggcgtgccgcacacctccagcgcgttggcgcgtaccagtgggttgttcttgaacagttcgatcaggtcgccatggaatgcagctggcaagcgcgtggtgtcgttgttccagaacaggatgtcgaacaccggcggctcgttgcccagcaggtaattattgacccagtagttccagatcaggtcgttggggcgcatccaggcgaacaccttggccatatcgcggccttccagcacaccggcctggtacgaatggcgcttggctgcttcgagggtctgctcgtctacaaacagcgccacctgggtgtccagggtggtgtccagtacgctcaccagcagggtcagggcgttgaccttcttctcgcccagcgccgcgtagtggcccagcagtgctgtgcaggtgatgcctccggaacaggccgcgagcatattcacgtccttactgccggtaatcgccgtgaccacatcgaccgcttccttgagcgcctcgatataagtcgacaggccccactcgcgctgggccttggtggggttgcgccagctgacgataaacgtctgctgcccattgcgcaggcagaagcgcgccaggctcttatccgggcacaggtcgaatatgtagaacttgttgatctgcggcggcaccaccagcagtgggcgctcgtgtacttgctcggtggtgggcttgtactggataagctccagcacgtcgttgcgaaacaccaccgcgccttcgctggtgcccaacgtcttgccgacttcaaaggcacccatgttgacttggctcggcatgccgccgttatgcaccatgtccttggccaggtgggacaaaccgtcgagcaggcttttaccgccggtttcaaagaagcgcttgaccgctgccgggttggccgcgctgttggtgggggccatggcttcggtcatcaggttgatcacgaagtggccgcggctgatgtcctgtgcggacaggctgctgtcgtcgatccagtcgtggagttccttgcgccacgccaggtaagtctgcaagtagcgtttgtagagcgggttctggctccaggccgggtcgttgaagcgacggtcgtcgccctcgggcgccaggggggatttgccgaacatcacattcttcaattcgacgccaaagtgggcgacgtgcttgacgctgtgcaacggttgcttgatggcttgggtcagcaccatcctggccgaggccaatagatcctttttgcgtaacgcgatgatcgggttcagccccagggtgttttccgaggcctggcgtttcaagtcatcgttattcttgttactcatctacgacgctccgttgtccgaaagacgagtaccggcgattgctgcgcacccaatttcgatacacgacaccagcctggtactgcgacccgggtgaccgttgataccgcatcgtcaaatgcagggaacttgccagttccattggttacccgagtttattttttttcgcaagcgggccgatcattggcctcgcgacagggcattcaagcagatgaaattagaaaatgccctctaaagagcaagacgcctgggctagagcatcagccgcacgaccgactggttcgggtcgcgggtttttccggccgctttgagctcggccaggtagtcgctccacagtgcgtcctgacgtacggccagttggtagaggtagtcccaggtgaacagcccgctgtcatggccgtcgtcgaaggtcaatttcagtgcgtactggccggccggttcgaccttgttcaacctgacgttgagcttgccgaattgcaggatgggcttgccgtgtccctgcacctcggcggaaggcgagtgcacccgcaggaattcggcgggcagatgataaacctcgtctgggctgtaagtgaggccgagggtgttggaggttttgtgcaggtttacagcagtaggaaacttggccatatgaggtactcctgaataaaccggcttaaaaatgtgggagggggcttgcccccgatgacggtgtgtcagtcagctcatctgatactgaaacaccgccatcgggggcaagccccctcccacatttgaagcaaagcagttctgtgtgaggcttacaggatataacgagacaagtcttcgttctgcgccaattcgcccaggtggctgttgacgtagtcggcgtcgattttgatcgcttcgccattctgcgcaccggccatgtcaccagcactgaacgatacttcctcaagcaggcgctcaagcaaggtatgcaggcggcgggcaccaatgttctcggtcttctcgttgacctgccaggcgatttccgccaaacgcttgatgccgtcggcctggaactcgatacccaagccctcggttttcagcagctcacggtattgctcggtgagcgatgcgtgaggctcgctgaggatgcgctcgaagtcgcctggggtcagcgccttgagttccacgcgaatcggcaggcggccttgcagctcgggcaccaggtcgcttggcttgctcaggtggaaggcgccggaggcgataaacaggatgtggtcggtcttgaccatgcccagcttggtgttgactgtgcatccctcgatcagcggcagcagatcgcgctgcacgccttcacgggagacatcgacgccgccggagttaccgcgcttggccaccttatcgatctcatcgataaacacgatgccatgctgctcgacagcttccaatgccttggccttgagttcttcctcattgaccagacgcccggcttcttcgtcgcgcaccagcttgagcgcttccttgaccttgagcttgcggctcttcttcttgcccttgcccatgttggcgaacaggttctgcaactggctggtcatttcttccatgcccggcggagcggaaatatccacaccggacacttcggccacttcaatctcgatttccttgtcatccagctggccttcacgcaggcgcttgcggaacagctgacgggtgttggaatccgaggacggtgcggcgtcttcgttgaaacccatgcgtgccggtggcagcagggcatcgaggatacgttcttcagcggcgtcttctgcgcggtggctgaccttggtcacttcctgttcgcgcagcattttcagggcagcgtcggccaagtcacgaatgatcgactcgacgtcgcggcccacatagccgacttcggtgaatttggtcgcttccaccttgatgaacggcgcattggccaacttggccaggcgtcgggcgatttcggttttaccgacaccggtcgggccgatcatcaggatgttcttgggcgttacttcaacgcgcagttcttccggcagttgcatgcggcgccagcggttacgcagggcgatggcaacggcgcgcttggcatcgtcctggccgatgatatggcgattgagttcatggacgatttcgcggggagtcatggacatagttgtttggcggcctcaagcgagaataagcccaaggcttactcggcgaggtcctgctcctcaatggtctggttgtggttggtgaacacgcagatatcgccggcgatgcccagggcggtctcgacgatttcccgggccgacagatcggttttcttcagcaacgcactggctgccgcctgggcgtagccaccgccggaacccatggcgatcaggccgtgctcaggttctaccacgtcgccattgccggtgatgatcagggacgcgtctttgttggcgacggcgagcatggcttcaaggcggctgagggagcggtcggtgcgccattccttggccaactcgacagcggcgcgcaccaggtggccctggtgtttctcaagctggccttcgaagcgttcgaagagggtaaaggcgtcggcggtagcgcctgcgaagccggcaagcacctggccgtggtacaggcgacgcactttcttcgcgttgcctttcattacggtattgcccagggaaacctggccgtcgccgcccatgacaactttgccgtggcgacgtactgaaacgatggtggtcaaggggagagtctccacgcagcggggcgaaaatgccctgatggaaactcatatgggggtggcggtggggatttcaaccgtaggacgagagcgcggacgagtggtgtttaccgctctgacacctaaccaagcacaccgcaaaatcaaatgtgggagggggcttgctcccgatggcgcgctgtcagccaatgaatatgttgactgacactccgctatcgggagcaagccccctcccacattttgatttgtgttgaccccgaatcagcgactctggcgctgttgtaacaacaggttgctgaacccggcgccggccaattgtttctgtgccacggtcagttgctcacggttgctgaacggccctaccagtacgcgataccaggtcgcttccttcaccgtgccggactccaccgtcaccgactggcccaacaggatgatctgcgcccgcacccggtccgcatccgcctgtttcgggaacgagcccgcctgcaggaagaacttggtcaccggcgcggccttggtggcagcgaccggcggtggtggcggcggcgtgatcccggccagcgcggcctgggcgcgggcggtgtcgattttcgcggcttcggcaggtgtcaccggcgtggttggcacttgcggcgtcggcagggtcttctccggcacggcatcaggaggcacgatcacttccgattccggcagcagggtgtagaagtcgtacttcggcttcaccggtgcagtcgggctcggcgcggttttgttggcctcggcgattttcgtggccttctgctgctcctgtttgacgcgcttgacgtcgtcgccctggccaggttcgagcttcatcaaaaatacgatgaatgcgccgaccgtgaggccgatagccatccacagccagcccggaatcggctgcttcgccggggcctggtagcggctggcgccgcgcttgggggcaggttttttcttggcggccaacttacatgcgctccagggtttccaggcccaagagttccaggccttgcttgagggtgcgtccagccagggcggcgaggcgcaggcgactttgtttctgggcttcgtcgtcggcggtcaggatcgggcagttctcgtagaagctggagaacaacccggccacttcgtacaaataggtgcacaggatatgcggtgtgcctttctcgccgacgctgttgagcacttcgccgaactgcgccagcttggcggccagttcctgctcatgggcggcatccagcacgatctggccttcgacttcgctgaagtccttgcccagcttgcggaacacacccgccacgcgggtgtaggcgtacagaaggtacggcgcggtgttgccttcgaagttgagcatcaggtcgaagttgaagctgtagtcgctggtgcggtgtttggacaggtcggcgtatttcaccgcgccaatacctaccacgcgggcgatgttgcgcaggtcggcctcggccagctccgggttcttttccttcaccaagctgtaggcgcgttcctgggcttcggtgagcaggtcgatcagcttcacggtgccgccgtcacgggtcttgaacgggcggccatcggcgccgttcatggtgccgaaccccatgtgttccatgtgcatcgggtgggtgacgaagccggcacgacgggccacttcgaacacttgctggaagtgcagggcctggcgctggtcaacgaagtacagcgcacggtcggccttgagcacgccgctgcgatagcgcacggcggccaggtcggtggtggcgtagaggtagccgccatcggccttgacgatgatcaccggcagcggctcgccgtcggcggtcttgaattcttcgaggaacacgcactgcgcgccgttgctctccaccagcaggcccttggccttgaggtcgttgaccacgttgatcaggtcgtcgttgtaggcgctttcacccatcacgtcggccatggtcaacttcacgttgagcagctcgtagatttcctggcagtgggacagggaaatttcccggaagcggttccacagcgccaggcactcctcatcgcccgcttgcagcttgaccaccaggccgcgggcgcggtcggcgaattcttcggattcgtcgaaacgcttcttggcggcgcggtagaagttctccaggtcggccagctcgttgctggtgatcgggttttcctgcaggtaggccatcagcatgccgaactgggtgccccagtcgcccacatggttctggcggatcaccgtatcgccgaggaattccagtacccgggccacgccgtcgccgatgatggtggagcgcaggtggccaacgtgcatctccttggccaggttcggcgccgacaggtcgatgaccacgcgctgggcggcaccagccttgtgcgcaccgatgttggcatcggccagggcggcgtccaggcgcgcagccagggcctgggtgttctggaagaagttgataaagcccgggccggcgatttcggccttggtcacactggcgtcagccggcagcgcggcaatgattttttccgccaggtcgcggggtttcataccggccggcttggacagcatcatcgcgatgttgctggcgaagtcgccgtgggtcttgtcgcgggtgttctccacctggatcgccggcgacaggccttcaggcaacacaccttcgttgacgagttgggtgagggcttgttggagcagctggcgaatggtgtctttcatggtgttctctttcgaccgcaagcggcggcgcgcgatgcgcaggtggaaaaactgggcattatccgtggcgagggcgagcttgccaaccgttccggacctgtggagcattttgtaggagtgagcttgctcgcgaaaatcgtcaacgataacgcgggcttcctgatttaacgcggtgttcttgagtttttcgcgagcaagctcgctcctacagtggtgggtggatcagtacaaatctaccgggtctacatccagtgaccatcgcacttgtcggccgctgggtatttgctccagctcaagcatccagcgacttaatagccgatgcagcggcgcacgggaggttgcctgcaagagtagctgagcgcgataacgtccggcgcgacgctccatgggggcgggtaccggcccgagcaattcgatgccgctcagactcaattcacccagcaaaccctcggcggcactgcaggcttcatccaggaaaccttcggcttgtcccggtttatgcgcctcggcacgcaacaatgccaggtgtgcaaagggcggcaggccagcggcacggcgttcactcaaggcctgctcggcgaaggcaaagtagccttgttccgtcagttgaatcagcaatggatggtcggccaggtgcgtctggataatcaccctgcccggctcttcggcccgtccggcgcgccctgccacctgcacgatcaactgcgccatgcgttcgctggcgcggaaatccccggagaacaacccgccgtcggcgtccaggatcgacaccagggtcacccgcgggaagtgatgccctttggcaagcatttgcgtgcccaccaggatgcacggctggcctttctgaatggtggcaaacaactggttcatcgcgtctttgcgcgaggtgctgtcgcggtcgacccgcagcaccgggtaatccggaaacagaatgcccaggcgctcctcggcgcgctcggtgccggcccctaccggacgcaggtcgaccttgccgcactgcgggcaatggcgtggcacccgctctacatggccgcagtggtggcagcgcagttcgccatagcgctggtgcacggtcatgcgtgcatcgcagcgttcgcacccggacatccaaccgcagtcatggcacagcagcgtcggggcaaagccacggcgattgagaaacaccaacacttgttggcctgcggcaagggtctggccgatggcctgttgcatcgggccggagataccactgtccagcgggcggctctttacgtccaggcgcaggaagcgtggttgcttggcaccgccggcgcgctcattcaggcgtagcagcccgtagcgtccggtgtaggcgttgtgcaggctttccagggacggcgtggccgagcccagcacaatcgggatgtcttcctggcgtgcgcgcaccagtgccaggtcgcgggcgtggtagcgcaggccttcctgttgtttataggagccgtcgtgttcctcgtcgatgatgatcagcccggggttcttcatcggggtgaacagcgccgaacgggtgcctatgatgatgtcggcctcaccgtcccgcgccgccagccacgactccaggcgctcacggtcattgaccgccgagtgcaccagggcgatgcgggcgttgaagcgctgttcgaaacgcgccagggtctgtgggcccaggttgatctcggggatcagcaccagtgcctgcttgccggcctgcagggtttcgcggatcagttgcagatacacttcggtcttgccactgccggtgacgccggccagcaggaacgcatggaaactgtcgaaccctgcgcggatcgcctcatacgcggcgcgttgctcggggttgagcggcaattccggttgggccagccagtgttcgtggcgcgggtcgggggcgtgcttgcggatttccacctgcaccaggcccttggccaacagcaggtcgaggctgtctttgctcagcatcagcttgcttaacagctgatgggcgacgccatggggatgctgggccagtgtggccagggcttcacgctggcgcggggcgcgggcgatacgcgggtcgtccaggcgtgcaccgggcgccatcgaccagaaacgttcctgtcgcgcttcggccagttcgccctggcgcagcagcaccggcaaagcccagctcaaggtatcgccgaggctgtgctggtaatactgcgcggtccacaggcacagcttgaacagctcaggcggcagtggtggcgtggtatcgaggatggccagcgccggtttgagtttctccgccgggacttcgctgtgatcggtgacttctaccaggatgccgatcatctcacgccgcccgaacggcacgcgtacgcgcatccccggctgcaactgcgcccgcagcaccccggcctgagcccggtaatcgaacaggcggcgcaggggcgagggcagggctaggcgcaaaatggcgtcgggcacgcgaggggtctcatataaaggcaggcggtggtgcaggggcgcgagcctagcagacgagggggggcttgggtatgcctcgcttttctgatgaaaggcgcttttatctttacaagcaaatagtgttgccgcttgcgcgtttaaaaaggtctggtagaatccgcggcctaattacgtgcggtattcgacaatagtgtcgagtggcggcacgctagcccgaggaagtgccatgaaagccgatatccatccagcgtacgaaaccatcgaagtcacctgcagctgcggcaacaagttcgaaacccgttcgaacctgtgcaagccactgggtactgacgtatgcaacgagtgccacccgttctacaccggtaagcagaaaactctggacaccggcggccgtgtacagcgcttcgcagatcgctttggtgctttcggcaagaagcctgctgctgctactccagcagagtaaggttcaagagccttatgggcttttgccagctgttgaaaaaggcgtcccttgtgggcgccttttttgtgcctggcatttggctggcgaccgcccgggccgaagcattctgccccgcaccggcctctgtggtgcgtgtcgaggtgcagcgggtggtggacggcgacaccgtgcgcctcaaggatggccgcagcgtgcgcatgatcggcctcaatgcgccggaaaccggcaagaagaggcgcgctgacgagccatttgccgtcgccgcccgccagcgtctacaggcgctggtgcaggccagcgatgggcgtgtcggtctggtgccggggcgcgagggcaaggatcactacggtcgcaccctggcccatctttacggcgccaacggtgagaacctggaggcgcaattgttggctgagggcctgggtttccaggtgggcgtggcgccgaatgtggacctggtcgcctgccagcaggccgccgaaaacagcgcccgccaagcgcggctcggcctatggcgccaaacgccagtgcaaaccgttgggcaactcaagcattccggctttgctttgatcactggccgggtcagcaagatcgagcgcaatcgcggtggcatttggattgaattacagggctcattggtattacgcattgcacccgatctgatcagtcgtttcgacgcgaccctgctcaatggtctgcaagggcgtaccatcgaggcgcgtggctgggtgcaggatcgcttgcgacgcggcggcctgaaaaaaggccagtcacgctggctactgccactgaccgaccccagcatgctgaaatcaacgtcttgaataaaaaaattgtagacattttttatttcgattgtgaacagttgagcccttgtatcccgtggctcttggccaaaagtcgtagcccagggcccttgacacccgtgactgcccagtcttgtaggtaaattgctacgcgcgtatcctcggcggtccgtcgaccaacagtaaaagcggaatgccgatatgtctgatttgaaaactgccgctctcgaatatcatgcccatcctcgtccaggaaagctgagtgtagagctcaccaaagccactgccaccgctcgcgacctgtcgctggcctacagccctggtgttgccgagcccgtacgtgaaatcgcccgtgacccggaactggcgtacaagtacaccggcaagggcaacctggttgcagtgatttccgatggcaccgcgatcctcggcctgggtaacctcggcccattggcctccaagccagtcatggaaggtaaaggcgtgctgttcaagcgctttgccggcatcgacgttttcgacatcgaagtcgattccgagagcccgcaggctttcatcgacacggtcaagcgcatttccatcactttcggtggcatcaacctggaagacatcaaggcacctgagtgcttcgagatcgaaaaagccctgatcgagcagtgcgacattccggtattccacgatgaccagcacggcaccgccatcgttaccgcagccggcatgatcaacgccctggaaatcgctggcaaaaccctgggcgaggcgaagattgtctgcctgggcgccggcgctgcggccatttcctgcatgaagctgatcatcagcatgggcgccaagctggaaaacatctacatggtcgacagcaagggcgtgatccagtccgagcgtaccgacctgaaccagtacaaggcgatgtttgcccatccgtcctccaagcgcaccctggctgacgccctcgacggtgccgacgtgttcgtcggcctgtccggcccgaacctgctgagcgccgaaggcctgaagtccatggcaccgaacccgatcgtgttcgcctgctccaacccagacccggaaatctcgcctgagctggcccacgccacccgcagcgacgtgatcatggccactggtcgttcggactaccccaaccaggtcaacaacgtcctgggcttcccgttcatattccgtggagccctggacgtacgcgccaagcgcatcaacgaagaaatgaaagtggccgccgccaacgccctgcgtgaactggccaagctgccagtgcctcaggatgtctgcgacgcctacggtggcgccaagctggaattcggtcgtgagtacatcatcccgaaaccaatggataagcgcctgatcaccctgatctccgatgccgtggccaaagccgccatcgagaccggcgtggcgaccctgccgtatccgaagcactacccgctgcagagcgtggatgatgtgttcaacggctaagctgttgtagcgcaccaacaaaaagccccggctcgaatgagtcggggctttttttatggcaattctcttgaagccgatagaggtcaaatgtgggagggggcttgctcccgatggcggtgtatcagtcgccatattcattgactgacagtccgccatcgggagcaacccccctcccacatttggatctatgttgcgtcttggatcgggtcagaacaaatcgatcggcgcgccttcatccgccggcagcgggctgcccggtgccacgccattgcccagctcgttgaccgacggcggcgtgtcctcgctcttgaacagctcgaagtaagcattcggcgtactcggcgaggccgcacgtccactgatcggatcgatgcgcaggctgaggatgccttccggttccggttgggtgtgcaaaggcttgtccttcaaggccgcgcccatgtagctcatccagatcggcagggcgacggtgccgccaaactcgcggcggcccaggctttcaggctggtcgtagccggtccacacagtggtcacgtagtcgccgttatagccagagaaccaggcgtccttggattcgttggtagtaccggtcttgccggcaatatctgcgcggcccagggccagtgctcggcggccggtgcccttcttgatcacgtcttgcaggatgctgttgagaatataggtggtacggccatccacgatgcgctcggcaactgccggggcttgcggttcggtggtcgcgggggcggttgccgcaggcgtcgtgcctggggttggttcaatggtgatgccgccattactcggtgccgcgaggccatcggtcgctgccaccccattgaccacgtcgcccggcacccgcggtgggttggcggtgaacagcatgtcgccattgcggctttcgatcttgtcgatcagatacggcgtgatcttgtagccgccgttggcgaaggtgctccagccggtggcgatttccatcggcgtgagagtcgcggtacccagggccagggacaggttcggcggcaggtcggacttggcgaagccaaagcgtgtcatgtagtcgatggtcttgcccacgcccattgcctgcaacaggcgaatcgacacaaggttgcgcgacttgtacagcgcttcgcggatacggatcgggccgaggaaggtgttggtgtcattcttcgggcgccagaccttgtccagatattcatcgacaaacacgatcggcgcgtcgttgaccaggctggcggcggtgtagccgttgtccagcgcggcgctgtagacgaatggcttgaagctcgaacccggctggcgcttagcctgggtggcgcggttgtagttgctctgctcgaatgcaaaaccgccgaccaatgcacggatcgcaccgttctgcgggtccagggacaccagggcgccctgggcgaccggcacctggctgaacttgaggctgtcatccttctgacgttgcacgcgaatcaagtcgcccacctgcgccacgtcggacggttgcttgggcatcggccccatgctgttggtattcaggaacggccgcgcccatttcatgctgtcccatgccacatgcgcttcgccggtacgggtcagcacctggatgccgtcttttgtcacctgggtgacgatggccgggtccaggccgctgatggagcgctgcttgctcaattcggtggtccacgcgctcagggtcttgccgggcaggcgcgattccggaccgcggtagccgtggcgctggtcataggtgatcaggccttcatgcaccgagttgttggcgatttcctgcaagttgctcggaaccgtcgtggtcacccggaagccttcggtataggcgtcgctgccatagcgcccaaccatctcggcacgggccatttcggcgatatacggcgcattcacttctggcgtcggcacgtgataactggcgttcagcggctcggccacagcgctttcgtaggcggcctggtcgatcttgcccagcttgtacatgcgccccaggatccagtcgcgccgctctttgctgcgcgccgggttggcgagcgggttaaagcgcgacggggccttgggcaggccggcaatcatggccatctgcgccaggctggcgtcacgaatcgacttgccatagtagacctgggaggcggcctcgatgccgtaggcgcggttgcccaggtagatcttgttgacatacagctcgaggatttcgtccttggtcagctgacgttcgatctgcagtgccagcaggatctcggtggccttgcgggaaaaactgcgctcgctggtaaggaagaagttcttcgccacctgcatggtaatggtgctgccgccggattgaatgtgtccgctttttaccaactgcgtggctgcacgcaccaggctgctggggtcgacgccgtagtggttggcgaaattgtcgtcttcggcagacagcaaggcgctgatgaaattgggcggaatatcggcgaaacggatcggtgtgcggcgcatttcgccgaactccgcgatcagtttttcatcgctgctgtagacccgcaaaggaatctgcaactggatacttctgagggcctctacggaaggcaaacccggactaaggtagaggtaggccccgctgagtacgagcagcagcccgcagacgatggcgacaatggagtacccgaaaaacttcagcagacgaatcaaggcttttggatttccagagaaaagaatgagttacgcgtcggggcatgcatggctaacgatggatcgacccgggcagcagataaaagcgggaaaaaacgctgggcattaaagcatttttcagcttggggcgtcattcgcgtgccttgagcaagccgaccggatgcaaggtgcctggcagcaatcagacgatacgacagccggtatgacagggaaagttttggggagttttatgggaaagggaattttcaggcgaaaagtcgacaccgtcctgggcgtcgatatcaatgacagcagtatcaagctggtagagctgggccgttcagcgggcgttttcagcgtccagggctacgtgacccaggcgctggcggcccatgcggtggtcgatggtaccctgttggacctcgaaggcgcggggcgggcattgctgcaggcattatcgcgcttgcgtccctcggcccggcatgcagccgtggcggtgggggggccttcggtgatcacgcggttgatcgaaatggacgcagggctcagcgatgaggaaatggcctggacgatccagatggaagccgatcagttcattccttatccattggatgaggtggccatcgactttcaggtctggggcccgtcggcccaggggccacaatgggtccaagtgatgttggcggcgtgcctgcgcgagcaggtcgaggcgcgtgaaacggttttgtcccaggcggggctggtgccgcgggtggtagatgtggaagagtttgcattggagcgcgcttgccgtcaggattttgccagcttcgcgccgggtcatcgagtcgatggcgcacaatgggccgtggatgcccaagggatgggagtggcttgcgggttggccctgaggagtttcgctggatgatacgaatcaatcttttgccttggcgccaggcgctggcggaacgcaggcgcaggtatttcctggtgctgttgctggtgtttgcctgcctggcactggctgcagtctggttggctggccaggtgatcgaccaagcgatagatcggcaggtaagtcgaaacaatcgcttgggtgaggacattggcgtacaggattcacggatcaggaccatcgacgacctgcaggagcgcagccagcaattggccgaacgcatgaaggttgtgcaggatctgcacgacgcccgttcttccggtgcccggctgttcgatgagttggctcgcgcagtgcccgagggcgtacatctgcatgaggtggtggcgaatggcgataccatcagcatccgcggcagtgctgaaagccaccaggatatcgcccagttgatgcgtcggctcgaggccacgcaaggggctcatgcgactcgtctggagcgcgtgcaggccgaaggtgagcgcggcgaaagtgaattccagctgatggttcgccagggggaaactgtcgaggcgcaaccatgagcctgtccaggctcgacgttttcacgctttcccacaacgctgccaaatggcccttgccctgccgggtcctgctcggctgtgcgctggccgtcctggtgttgctggtgggagaggttgtgtacctgggcccgtcgcgggagcggttgcagggggtcgaggcgcgagggcatgtgctgcaacagcagcttgcagaaaaaaccggattggccgccactcttgaagtgcgcactgagcggttgcgcgcgatggagaataagctcgcaggccttctgcgacagttgcccgcagagtccgaagtgcctgccttgctcgaagacgtggcccggttggcggttgccaacggtatatgggtggagggcctcacggtgctcgaagaagagccccgccaactctacaccgggcaacctatgcaggtgggcgccactggggcctaccacgacctggcggcgttcgtcagtgccttgggtgggctgcagcgggtcgtcaccgtgcaggatgtcacgcttcggcctgagggtgccttgctgcgtctggaaatgttggccaagacctatcggggcaccacgccaagcgacaaggtccgccaggcgcttgagtcaggcccgcgatttgtctacgaccctacggccctgcgcgatccgttccagtcgcccaccttgcaggtcgcccgcgcgcccggtcggccggcgctttcgccggatctcacccggccacgggggatgctggagggcatgaccatcgatcagttcgaaatggtcggcacactatccaatgacatgcaggctttcgccttgctgcgggtggggtcacgggtgcaccggctggcggtcggtgattaccttgggccggaccatggccaggtcacggccattcaagacgggtatgtcgaactggtcgagctgttccccgatgaacagggcgcatggctggagcgcccgcgaaccctgatgctgaacgtcaattcataacggaatctaacaatgaaaaggactttctcgtccttcggtgtggcgctatggatagcgttcacggcaccgatggctgccgctgtgcccaatcgcccggacctgatccacctgccgccgcctgacagtgcctcgccggtcagctatacgggcaaaaaactgaccctcaatttccaggacatcgacctgcgcgcggtattgcagcaaatcgccgatgtcgccgggctcaacctggtgaccagcgacgaggtgcagggctcgatcaccctgcggctcaaggacgtgccctgggatcaggcgctggacctggtgctgcaaaccaagggcctggacaagcgggtgaaggccggcgtgttgctggtggcgcccgccgatgaattggccgctcgcgaactgctggtgctggagtcgcgcaagcagatggccgagctggcacccttgcgtcgggaattattgcaggtcaattacgccaaggctgcggacctggccaagctgttccagtcgatgaccggctttgaaggtggcacggatgaacgcggctcggtggcggtggatgaccgcaccaacaacatcatcgcctaccagaccggcgaacggctggaagagctgcggcgcatcgtggcgcagttggatatcccggtacgccaggtgatgatcgaggcgcgaatcgtcgaggctaatgtcgactacgacaaaagcctgggcgtgcgctggggtgggcggctcagccgcggcaactggggcgccgggggtatttccaagcccgtggcggacggcgccgagcctccgcaaagcccgcccagctcacccttcgtcgatctgggttcgctgaccggcacgtcggggctgggtatcgcctacatcaccgacaacctattgctggatcttgaactgacggcgatggagaaaagcggcaacggcgaaatcgtttcgcagcccaaggtggtcacgtccgataaagagaccgcacgcatcctcaagggcaccgagattccctaccaggagtccacctcccagggcgctacctcggtgtcgttcaaggaagcgtccctttcactggaggttacgccgcaaatcacccccgataaccacgtgttcatggcggtcaaggttaccaaggacgagcctgactatttgaaccggctcaacgacgtgccgccgatcaagaaaaacgaagtcaacgccaaggtgctggtccgggatggcgagaccattgtcatcggcggggttttctctaatacccaaagcaaagtggtagataaagtgccatttttgggcgatgtaccgtatcttggccgccttttccggcgcaatgtgctgtcggagaaaaaatctgagctgctggtattcctgactccgcgtattatgaataaccaggcgattgctgtgagtcgttgattctgtgcgaaatttgattcttgtaggaccgatgggtgctggaaagagcaccatcggccgtttgctggccaaagagctgcgcctgccattcaaagactccgataaggaaattgaattgcgcacgggtgccaatatcccatggatcttcgataaggaaggcgagctgggctttcgcgaccgcgagcaggcgatgattgccgaactgtgcggctgcgatggcgtggtgttggcgaccggcggtggcgcagtgatgcgcgatgaaaatcgtcgggcgctgcataccggtggtcgggtggtgtatttgcacgcgtcggtcgaacagcaggtgggccgcaccgcccgcgatcgcaatcgccctttgctgcgcacggccgacccggcgaaaaccttgcgggacctgctggcgctacgcgatccgctatatcgggaaatcgccgatctggtggtggaaaccgatgaacggccgccgcggatggtggtgctcgacattctagagcgcttgcaaaggttgccgccccgttaaagcctggcccgaaatgcgctattctcggcggcgcgccatgacttgcgaggtgtggcgtagagctatcaggcggtgtcggatcacggcgttgccggtcgtcaatatatcttcaacgcggggacacatgcagacacttaaggtcgatctaggcgagcgcagctacccgatccacattggcgaaggcctgttggaccagcccgagctgcttgcgccgcatattgccggtcggcaggtggcgatcatctccaacgaaacggtcgcaccgctgtatcttgagcgtctgagccgcagccttgcggcgtattcggtgatctccgtggtgttgcctgacggcgaagcccacaagaactgggaaaccctgcaactgatctttgatggcctgctgactgcgcgtcatgaccgtcgaaccaccgtggtcgccctgggcggcggtgtgatcggcgacatggccggttttgccgcggcctgctaccagcgcggcgtggactttatccaggtgccgaccaccctgttgtcccaggtcgattcgtcggtgggcggcaagaccggtatcaaccatccgctgggcaagaacatggtcggtgcgttctaccagccccaagcggtgctgatcgataccaccaccctcaacaccttgccgccgcgggagctgtcggcgggcctggcggaagtcatcaagtacgggctgatctgcgacgagcccttcctgacctggctcgaagaacacgtagatgccctgcgcgcactcgaccaggtggccctgaccgaagcgatttcccgctcctgtgccgccaaggcgctggtggtgaatgccgacgaacgggagtctggcgtacgcgccaccctgaacctggggcataccttcggccatgcgatcgaaacgcacatgggctatggtgtgtggttgcatggggaagccgtagcggctggcactgtgatggcattggaaatgtcgcagcgcctgggctggatcagcgcccaggagcgcgatcgtggcattcgcctgttccagcgcgccggtttgccggtcatcccgccgacggagatgaccgaggccgatttcctcgaacatatggcaatagacaagaaagtgatcgacggtcgactgcgactggtgctgttgcgccacatgggcgaggcagtggtgaccgacgattatccgaaagagattttacaggccacgctgggagcggattaccgcgccctggcccagcttaaaggttaataagatcccgatgactagtttgcatgccgacgaggcgttcctcggccattatcacttgagccatgaccctttcgctccacgggtgcctggcttcaaattcttcccggcccagcgcaagcccgtgctggggcaactgcaccacctggcacgctacagccagctgctgctggtggtcaccggcccgttgggcagcggcaagaccttgctgcgccaggcgctggtcgccagcactaacaagcaatcggtgcagagtgtggtggtctcggcccgtggcgccggcgatgctgcaggcgtactgcgccaggtggcccaggcgctggacgtggccaatgccgagccaaacgcgattctcaagcaggtggtgcaactgggcctgaccggccaggaagtctatctgctggtggacgacgccgagcagcttgacgaatctgccctcgaagcgctgctggcgctggctgcgggcacgccggaaggtcgcccccacgtgttcctgtttggcgagtcgtcgttgatcgccgatctggagcagatcagcggtgatcaggagctgttccacgtcattgagctgcagccctacgaagaggaagaaacccgcgaatacctggctcaacgccttgaaggcgccggggcgggtatcgaacttttctccgctgcgcagatctctgatattcacgaaagctccgatggctggcctggcaacatcaaccaggttgcccgcgatgcaatgatcgaagccatgattgccagccgctcagcggtcaagcgtccaaagatggggttcactatgcctaagaagcacgtattggctatttctgccgttgtcgtggtcgctgttgccgccgcctggttgatcccgggccgcaataaagcaccgacaacgaccggcgcgccaactgagcaggcgcagttgccactgggtaagcccacgccaaacgtcgagttcgccaactccggccagccgaccaacctgccgatggttggtcagcctgtaatgcgtggcccgctcgccgaagaagccggtggcatttctgaaggcgatgacggtgtgccggtggaaggctccagtgccacgccgccgaccgtgaccaccaccgcgccaccagcgggcgtaccggccggcacgccagcaaccccagtagcgcctgccgcaccggttgcgccagttgccaagccgaccccggcgccgacggtcgcgacagccaagcccgcagcaccagttgccaagccggcaccggcacccgcggccaagcctgctgaaaaaccagccgctaccgtggccaaggccggcgccgctggcagcagctggtacagcagccagcctaccggcaacttcgtggtgcaaatcctcggcaccagctccgaggccaacgcccaggcgttcgtcaaggagcagggcggccagtaccgttatttcaagaaagtgctcaacggcaagcctctctacgtgatcacctacggcagcttcccaagccgcgccgcagccgattctgccatcaaggccttgccagcgaaggttcaggctggtaaaccttggcctcgcactgttgccagcgttcaacaagaactggcagcaactcgctgaagatccggcggccttacccaggccgccctcccggcacctcaaaaaacaatcgcaaggcgtgcagtcccccgcaaggaccgcgcgctttgtggtgtctgcgccacagtagcttttgagtcgtagcggtcagaattaaaaaagttttgactagcacagcatatcgctttaaacctttcataaatgcgacatagatttgcgacatttcgtcgctaaatttgtgagcgtctgtgtcggtgtgtacaatgacctcccttttgcccccgctaagccggcgtacgttcggcgtggaaggtaaccggttgaattgaaaagaaatttgcctcgaaataagaggcagcctggtgagaaagtgtctatgaaagcaggtctgtaccaacccgatgaattcaaggataactgcggtttcggcctgatagcccacatgcagggcgagcccagtcatacccttttgcaaacggccatcgaggccctgacctgcatgacccaccgcggtgggatcaacgccgacggcaagaccggtgacggttgcggcttgctgattcaaaagcccgaccagttcctgcgcgctgtcgccaaagagcattttgcggccgacctgcccaagcagtacgccgtgggcatggtgtttttcaaccaggacccggtaaaagccgaagccgctcgcgagaacatgaaccgcgagatcgttgctgccggcctgcaactggtcggctggcgcaaagtgccaatcgacaccagcgtactcggccgcctggccctggagcgcctgccgcagatcgaacaagtgttcatcgcaggcgacggcctgagcgaccaggacatggcgatcaagctgttcacgtcccgtcgtcgttcgtcggtgcttaacgccgccgacactgaccattacatctgcagcttttcccacaagaccatcatttacaaaggcctgatgatgccggcggatctcaccgccttttatccggacctgagcgatgagcgcctgcaaaccgcgatctgcgtgttccaccagcgcttctccaccaacaccttgccgaaatggccgttggcccagccgttccgctttctcgcccacaacggcgagatcaacaccatcaccggcaaccgcaactgggccgtggcccgtcgcaccaagttcgccaacgatttgatggacctcgaagagcttggcccgctggtcaaccgcgtgggttccgactcctccagcatggacaacatgctcgaactgatggtcaccggtggtatcgacctgttccgtggcgtgcgcatgatcattccgcctgcgtggcagaacgtcgagactatggacccggacctgcgggcgttctacgaatacaactcgatgcacatggaaccctgggacggcccggccggcgtggtcatgaccgacggtcgctacgcggtgtgcctgctcgaccgtaacggtctgcgccctgcgcgttgggtcaccacgaccaacggcttcatcaccctggcgtcggaaatcggcgtgtggaactacaagccgcaagatgtgattgccaaaggccgcgttggcccgggccagatcctggccgtggacaccgagaccgggcagatcctcgacaccgacgccatcgacaaccgcttgaagtctcgtcacccgtacaagcaatggctgcgcaagaacgccctgcgcatccaggcgaccatggaagacaacgaccacggttcggctttctacgacatcgaccagctcaagcagtacatgaagatgtaccaggtcacgttcgaagagcgcgaccaggtgctgcgtccgcttggcgaacaaggctacgaggccgtcggctccatgggcgacgatacgccgatggccgtgctgtcccagcgcgtgcgcaccccgtacgactatttccgccagcagttcgcccaggtcaccaacccgccgatcgacccgcttcgcgaagccatcgtgatgtccctggaagtgtgcctcggtgccgagcgcaatatcttccaggagtcgcctgagcacgcttcccgcgtgatcctcagctcgccggtcatctccccggccaaatggcgctcgctgatgacccttgagcgtccaggtttcgaccgccagatcatcgacctgaactacgacgagagcctcggtcttgaagctgcggtgcgtaacgtcgccgaccaggccgaagaagccgtgcgcgccgggcgtacccagatcgtgctgaccgaccgccatatcgcgccaggcaagctgccgatccacgcttcgctcgccaccggcgcggtgcaccaccgtctgaccgaaaagggcctgcgttgcgactccaacatcctcgttgagaccgctaccgcccgtgatccgcatcactttgcagtgctgatcggtttcggcgcgtcggcggtgtatccgttcctggcgtacgaagtgctcggcgacctgatccgtaccggtgaagtcctgggcgatctctatgaagtgttcaagaactaccgtaaaggcatcaccaagggcctgttgaagatcctgtcgaagatgggcatctccactgtcacctcgtaccgtggtgcccagttgttcgaagctatcggcctgtccgaagaagtctgcgagctgagcttccgtggcgtgccgagccgcatcaagggcgcacgtttcgtcgacatcgaagccgagcagaaagccttggcgttggaggcctggagtgcgcgcaagccgatccagcaaggtggcttgctcaagtttgtgcacggtggcgaataccacgcctacaacccggacgtggtcagcactttgcaagccgccgtgcagcagggcgactacgccaagttcaaggaatacacgagcctggtggataaccgcccggtgtcgatgatccgcgacctgttcaaggtgaagactttggacacgccgatggacatcagcgaagtcgagccgctggaatcgatcctcaagcgcttcgactctgccggtatttccctgggggcgttgtcgcccgaggcccacgaggccctggccgaggccatgaaccgcttgggtgcgcgttccaactccggtgaaggcggcgaagatccggcgcgctacggcaccatcaagagctcgaaaataaagcaggtcgccactggtcgtttcggcgttacccccgaatacctggtcaacgccgaagtgctgcagatcaaggtggcccagggcgccaagcctggtgaaggcggccagctgccaggcggcaaggtcaacggcctgatcgccaagctgcgttatgcggtgccgggcgtgacgctgatctctccaccgccgcaccacgacatctattcaatcgaagacttgtcgcagctgatcttcgacttgaaacaagtcaacccccaggccctggtctcggtgaagctggtggcggaagccggtgtcggcaccatcgccgccggcgtggccaaggcctatgccgacctgatcaccatctccggctacgatggcggtaccggcgcttcgccgctgacctccatcaagtacgccggcgcgccatgggaactcggcctggccgaaacccaccagaccctgcgcggcaacgacctgcgcggcaaagtgcgggtacagaccgacggcggcctgaaaaccggcctcgacgtgatcaaggcggcgatcctcggcgccgaaagctttggcttcggtactgcgccgatgatcgccctgggctgcaaatacctgcgcatctgccacctgaacaactgcgctactggtgtggcgactcagaacgaaaaactgcgcaaggatcactacatcggcaccgtcgacatggtggtgaacttcttcacctacgtcgccgaagaaacccgtgagtggctggccaagctgggcgtgcgttcgctggaagagctgatcgggcgtaccgatctgctggacatcctccaaggccagaccgccaagcaacaacacctggacctgacaccgctgttgggcagcgatcacatcccggcagacaagccacaattctgccaagtggaccgcaacccgccgttcgataaaggcctgttggccgagaagatggtcgagatggccagcgcctcgatcaatgacgccagcggtggcgaatttgccctggatatttgcaactgcgaccgttccatcggcgcacgcatctccggcgaaatcgcacgcaagcacggcaaccaaggcatggcgaaagcgccgatcaccttccgcttcaaaggcacggcgggccagagcttcggcgtgtggaacgccggcggcctgcacatgtacctggaaggcgacgccaacgactacgtgggcaagggcatgaccggtggcaagctggtcatcgttccgccggccggcagcttctacaagacccaggacagtgccattatcggcaacacctgcttgtacggcgccaccggaggcaagttgttcgccgccggcactgccggtgagcgcttcgccgtgcgtaactccggtgcccacaccgtggtggaaggcaccggcgatcactgctgcgagtacatgaccggcggctttgtcgcggtactgggcaagaccggttacaacttcggttcgggcatgaccggcggtttcgcctacgtgctcgaccaggacaataccttcgtcgacaaggtcaaccacgagttggtcgagatccagcggatcagcggtgaagccatggagtcctaccggaaccacttgcagcacgtgctggacgagtacgtcgaggaaaccggcagcgaatggggccgggaactcgccgagaacctcgatgattacctgcgtcgtttctggctggtcaagcccaaggctgccaacctgaaatcgttgctctccagcatccgtgccaacccgcagtgatatgcgcctgaacagtttgatgaggttttaacatggctgaacgtctgaataacgacttccagttcatcgatgtcgggcgcaaagatccgaagaagaaactgttgcgtcaacgcaagaaagagttcgtggagatctacgagcccttcaaaccccagcactcggccgaccaggcccaccgctgcctgggttgcggtaacccgtattgcgaatggaagtgcccggtgcacaacttcattcccaattggctcaaattggtggccgagggcaacatcctcgctgccgccgagctgtcgcaccagaccaacaccctgccggaagtctgcggccgggtgtgcccgcaggaccgtctgtgtgaaggcgcgtgcaccctcaacgacggcttcggcgcggtgacgatcggctcggtggagaagtacatcaccgacaccgcgttcgccatgggctggcgcccggacatgtccaaggtcaagccgaccggcaagcgcgtcgcgatcatcggcgcgggcccggcgggcctgggctgtgccgacgtattggtgcgtggtggcgtgactccggtggtcttcgacaagaacccggaaatcggcggtttgctgaccttcggcatccccgagttcaagttggaaaaaaccgtactgagtcaccgtcgtgaagtcttcaccggcatgggtatcgagttccgcctcaataccgaaatcggcaaggacatcaccatggagcaactgctcgccgaatacgatgcggtgttcatggggatgggcacctacacctacatgaagggcggctttgccggtgaagacttgccgggcgtgtatgacgcgctcgacttcctgattgccaacgtcaaccgcaacctgggctttgaaaagtcgccggaagatttcgtcgacatgaaaggcaagaaggtcgtggtgctgggcggtggcgacaccgcgatggactgcaaccgtacctcgatccgccagggcgccaagtcggtcacctgtgcgtatcgtcgcgacgaagccaacatgcccggctcgcgcaaagaggtgaagaacgccaaggaagaaggcgtgaaattcctctacaaccgccagccgattgcgatcgtcggtgaagaccgcgtcgaaggcgtgaaggtggtcgagacccgtcttggcgaaccggatgcccgaggccgtcgcagccccgagccgataccgggttccgaggagatcatcccggccgatgccgtggtcatcgctttcggcttccggccaagcccggcgtcgtggttcgagcagttcgagatccagaccgacagccagggccgcgtggtcgccccggagcaaggccagtacaagcaccagaccagcaacccgaaaatcttcgccggtggcgatatggtgcgcgggtctgacttggtagtgacagcgattttcgaaggccgcaacgccgccgaaggcatcctggactacctgcaagtctgaccccgatcctgaattgaaatgggatcaaactgtgggagggggcttgccccgtcccacatttgttttgcgctgcgttcaagctaccgcgacaaattgacccgatagacaaaaggcacggcgcattccgtgccttttgcgtcgcgctctgagaaaatgcccgcactttttttgcggatgccgacatgactgccctcaagaacgaccgtttccttcgtgccctgctcaagcaacctgtagacgtcacccccgtgtggatgatgcgtcaagccggtcgctacctgccggaataccgcgccagtcgcgcccacgccggcgacttcatgagcctgtgcatgaatcctgcgttcgcctgcgaagtcacgatgcagccgctggaccgctacccacaactggacgcggccatcctcttttccgacatccttaccattcccgacgccatgggccagggcctgtactttgagaccggcgaaggcccgcgtttcaggaaggtcgtcagcaccctggccgatatcgaagccctgccgattcctgatccgcacaaagacctcggctatgtgatggacgcggtcagcaccatccgccgcgagctgaacggccgcgtgccgctgatcggcttctccggtagcccctggaccctggccacctacatggtcgaaggcggctcgtcgaaagacttccgcaagaccaaggccatgctctacgacaacccgcaagccatgcacctgctgctggacaagctggcgcagtcggtcacctcttacctcaacggccagatcatggccggcgctcaagcggtgcagatcttcgatacctggggtggcaacctgtcggcggcggcgtaccaggagttctccctggcctacatgcgcaagatcgtcagcgggctgatccgcgaacatgaaggtcgcaaggttccggtgatcatgttcacaaagggcggcggcctgtggctggaaagcatcgccgatgctggcgctgatgcattgggcctggactggacctgcgatatcggcgaagcccgccgtcgcgttggcaaccaggttgcgctgcaaggcaacatggaccccactgtgctgtacgccaagccggaagcgatccgcacggaagtcgggcgcatcctggccagctatggcaagggcaccggccatgtgttcaacctcggccatggcatcacgccggaagtgaatccggaacatgcgggtgcattcctgcgtgcggtgcatgaactgtcggcgcagtaccacgagtgacggttgcctgataaagaacgcccggcctaggccgggcgttcttgtttgtggtcagcagacgtatggtgcttgtagtgtccgtcattgcggacataatgagcttcctatgcttataagtccgttataggtgacattatgttgctgaccactccacctgatctgggcgaaaggatacgacaactgcgtcgggccaggggctttagccaggcgcaactggcggaccgggccaagtgcaaccgcaagaccatcattgatctggaagcgggtgaaaatgtcgcgatgtacacggtgttccgggtgatttctgcactgggtatggccctggaagtcgtggataaacgcatcgatctcaaatccttggccgatctggtggagcacgatgagtagaatcaagttgctcaatgttgtgacaccccaggggcatgcaggcgatttgtctaaaggctcgcaattctcgttttcttattcatctgctgatgccggatgcgaggtatccctggtcatgccctacgacccgacacctgcggtcagtaacgtactgcatccgattttcgatatgaacgtaccggaaggttttctggccgatcagatcaaacgacggatggccaagcacatgcagatagacgagatgcgcctgttatcggtgatcggcggtaaccagattgggcggcttacctaccagaaccctgtcgaggcatcagtacccgtgaaggctcaggtgggcctccagcaaatactgtcagccgatacctcccagggtgtattcgagtttcttgtggagacgtatttcgagtcgggtatttccggcgtgcaacccaaggtactggtgcctgacctggacaagctgactggcagtcgcaaaaccatgctcagttctgacctgatcgtgaagtcgggtgccgatgaatacgttcacctggcacagaacgagttcctctgtatggaggctgcgcgcatagcaggcatggaaacaccacctttctggttgtccggagggggtgatctgtttgtgatggagcgcttcgatttgaactcgaccgggcggctgggttttgaggacatggccgttctgttgggactcaacaaagatccccacgacaattacaagtactcgcagagctacgagactctcgctgcggtgatcaatcacgtctgtgcgcagggtgatccgttacgcgagcttgagcggttcttttcttcggtttgcttgtcggtcatggtgcgtaatggtgacgcgcacctgaaaaacttcggtgtgatctacacccatcctggagcccgagaaacagtgcaattagcgcctgtcttcgatgtcaccaccactactgtgtatgagaactacaatccaaagtccggtcgttcattggttgatcgcaccttggcgataaaaatgaacaaggtcaaaacctatccggaccgtcagcaactgatggagtttggtcgtaagcattgtggggtggagaagccttgggtgatcattgagcgaatcgccgaggcaatgtccgaggcgctcgttgcccatcaagcgcgtatcgatatcgagctgttttcggcaatgcaggcggagtgggatggaggacgtgccatggcacttcatgattcgatcggcactggaatgaagcgaaagcccattgcgaaaaaaccgctgtgaagcggttttctcgttaaacagtgcctcaagctgctgtgtgtcccagcggcggcaacttcgccagcttcaacgccaccagcagcgcgccaatcagcagcgccacgataaacccgccaatcccgttccatccggcaaagtgccagaagaacccgcccgccgtcccggcaatactcgatcccacgtaatagcagaacaggtaaagcgacgacgcctgccccttggctttcaccgcacggcggccgatccagctgctggccaccgagtgggcgccgaagaagccgaaagtgaagatcaacatgcccggcaccaccagccacagcggcgtgaacagcgtcagcaacatccctgaaagcatcaacacgatggtgccccacagcacgcggcggcggccaaggcggtcggccagagagccgatcttggccgaactgtagatgcccgagaggtacaccagcgacagcaggcccactacggcctggctcagttcatagggtgaggccagcaggcgataaccgatgtagttgaacatcgttacgaacgcgcccatcaacaggaaggcttcgaggaacagccacggtaggcccgcatccttgaaatgcatgacgaagccatccaccaggctgcgcggcttgaggctgctggcgcggaagttgcgcgatggtgggaggatcttccagaacaccgtggccgcgatcagggccagggcgccgatgatcagcattgcggtgtgccaactgacgaagtcgatcaatacgccgatgatcagtcggccgctcatgccgccaatcgcattgccgccgatgtacaggcccatggccaggccgatgtgctgcgggtggatctcttcgctgaggtaggtcatcgccacggcagccaggccgctcagggacaggcccaccagcgcccgcatcagcagaatcccctcccaggtcggcatcagaccgctggcgatggtggccagcgccgcacagaacaacgcggcgaccatcaccggcttgcgccccagcctgtcggaaatcggcccggtgattagcaggccgcaggcaagcatcgcggtcgcgaccgaaagaatcaggctgctttgcgccgcattgatggaaaattcatgggacagcgccggcatcatcggttgtacgcaatacaacagggcaaaggtggcaaacccgccggaaaatagcgccaacaccgtgcgcatgaacatcggcgtgcctttttcgatgtactcgtcattaagctgcgccaccacctcatcgagggctgagggcggggtgtattgggcaagtggagcaacagcaggattcacgggggacctcggggaggaaagtctgccaggactgacaatacgaaaaagaatatagctggctaatgattctttccaatatattgttcgacctgtttgataggttctacgacctaatgaggtgtgcatggaattacgtcacctgcggtacttcatcgccgtcgctgaagaactgcactttggccgcgccgcgcaggtgctgggtatctcgcaaccgcccctgagccagcagatccaggcgctggaacaagaggtgggcgcgcggctatttgagcgcaccaatcgtcgcgtcgagctgagcgaggcagggcgcctgttcctgcaagaggcgcggctggtgttggcccaggtcgacaaggcggcagacgtggcgcgcagggctcaattgggagagctcggggagttgaagatcggcttcacgtcttccgcaccgttcaactccagcattccccaggcgatcttcgcgtttcgccaggctttcccggcggtgcacctcaatctgcaggagatgagcagcacggaggtggccgagtcattggtggatgagtcgattcaggtcgggctgatgcggcctttgccattgcccgattcgctgagcgtggtcgagttgatgcgcgagcccctggtcgcggtcttgaatgctggccatcccttggtggaaggcagcgagcgcggcttgcacctggcgcaattggcgcaggagccctttgtgtttttcccacgcacctacggcagcggcctgtatgcccaactgctcaacctggcccgcgacgccgggttcagcccgcattttgcccaggaagcgggggaggcgatgaccatcatcggcctggtggcggcggggttgggggtgtcggtgttgccggcgtcttaccagcgtatccgcattgatggcgtggtctaccgcacactgctcgacccggaggcgatgacggcggtgtggctggtgcagcgcaagggcgtgcaaacgccgatggcgaaggggtttgtggagttgttgacgcgtcaggtattggtgtaggcggggtcacatatcaggtaacgcaaccggcttaaaacgaacttacaaaatagccgaactcaccaatgaccaatttttggcgataaaagcggcggtgcgcagtgcgcttgggttgcgataaagtgggatatagatggacggcgttttgccaccgattgcaggtaacctgctttcaggcatactggccgagttcccgaaaaggggcttgtgagactctgagggtcctgggcaaccagccaccgcagagccaggcaggaagcggcgatgacaagccaacctgtttgtgaagagggcgcctaaaggcgccctttgtcgtttctggccttactgcatcccggtcgagcgcaaccctgccaggatgtccctatccagcatgcttatccaacggttgtagttgcgatggatcttgccgtccttgtagcccaggtcgcggctgtcgcggtaggtgatggcgtagctgttacgggtgtagcggatatcgatggcggcatagaactggccgcgcacggtgatctcggcctgcaccagttgcgggctcaggcgttgcaccgtccattcgcgtttctgcagggcggcgacgatggcctgtttcatcttttcttcactgacctggctggtagccggcaactcatgctgggtgttgagtaccggtttgctggtgcacccggcggtggtcagcagggccagggtgatcaggctagcgcgtagcagggaagacattccgttttctccaatcgattaaaagtcaggaccagcggcggaagatcaacgaggtgttgacgccgccgaaggcgaagttgttgttcatcacgtagtcgttgtgcatctgccgaaagccaccttgcaggtagtccagttcgccgcattgcgggtcgaccgaatccaggttgaaggtgtgcacgtactcgtcgcggttcatcatttcgatgctgaaccacgactccagcgcgccgcaggcacccagggtgtggcccaggaagctcttctgcgagctgatcggcatacgactgccgaacaggctgctggtggccagggtttcggcgatgtcgccttggtcggtggcggtgccatggccgttgacgtagccaatggcggacggttcaagcccggcatcttccagcgccagttccatggcgcggcgcatggttttctgctccgggcgggtggtgtgctggccgtccgcgttgctgccaaaaccaaccagctcggcgtggatgtgcgcaccccgcgccagggcatgttccagctcctcgagcaccagcatgccgccgccttcgccgatcaccaggccatcgcggacgctgtcgtatgggcgtgggctggtttgcggtgcgtcgttcttcaggctggtggcgtagagcgcatcgaacaccatggcttcggtggggcagagctcttcggcgccaccggcgagcatcaagggcagccgcccgaacttgatcgcctcgtaggcgtagccgatgccctggctgccgctggtgcaggcgctggacgtggggatcaaacgcccggtgaggccaaagaagatgctgatattcgccgccgtggtgtggggcatcatgcgcacataggagttggcgttgagcccttcggccaccgagttgagcagcatattgccgaaggccttgatctcatcggtgctgccggtggacgagccacaggccacgcccatgcgcccgtccttgatcgactcgtcaccgagcagaccggcgtcgtgcaacgcctgttccgccgcccacactgccaggcgcgagacgcggcccatgctgcgcagctgcttgcgggtccagtgggcgggcacgacgaaatcatcgatgggcccggccaagcgcgtgttcaattcggtaaagcggtcccactcatccatgcgtcggatgccgctgcggttggcgcgaaagttggcggcaatggtctcccagtcgctgcccagggaggtcatgccggccatgccggtgacgacgacgcgcttcatcagcacaggcctccgttcacggccagcacctggcgcgtgatatagccagcttcggccgacatcaggaaattcaccgcgccggcgacttcttccggggtgcccatgcgttgcgcggggatcattttcatcagttcttcgacggggacgttttcatccagcatcgccgtgtcgatcaacccgggtgccacgcagttgacggtgatcttgcgcttgcccaactcgatggccaatgctttggccgcgccgatcagcccggcttttgaagcgctgtagttgacctggccgcggttgccgatcaacccggagaccgatgtgatacacacgatgcgcccggcggcgcggcggcggatcatcggcatcattaccgggtgcagcacgttgtagaaaccatcaaggttggtgcgcatcaccacgtcccagtcgtcttccgacagcgccgggaacgcgccgtcgcgggtcaggccggcattgagcaccacgccgtagtaggcgccatgttgctccacatcggcttcaaggatggccttgcaactggcacggtcggacacgtcgaattgcagcacccgcgccttgcgccccagggtctcgatctcgacctgcacggcgtcggcttcggcgcgaccactgcggcaatgcagcacgatgtcatggccggcctgggccaggcgcagggcaatggcgcggccgatgccacggctggagccggtgaccagtacgggttcagtcatggcgtttggtccttcgattcatctagatagttggccgcctggggcggtcgaaatacgttcaagcgtgcgctggcctggatgccgtcgccggtgaggtggcattcgaacacacccatgccgttgtcgtcttccagggagcgcaagccatggatattcagctcggcgccggcgggaaagtgctccacgttgcactcgaatttacgcgtgcccaacaggaagcccagctctaccgcctggccttgctggcgcgcacggcagccggcataggcggcgacgctttgcgccatcaactccaggccgacccaggccggcaggctgccgtcagggcggttgaacaggccgccgggcttgacggtgacgcgggtgcgcacctgctcttcatcgaacgacagcacctggtcgatcaggatcatgtcgccggcatggggtagtagttcggcaagtggccaatcgatcatggggcctctgcaattatcaggctgacgttgttgccgccgaaggcaaacgagttgctcatcaggcaggtttttttcaaggtgtcgccgctgcgtgtccattgcaaggcgggcagcgccggatccgcttggccatcccatacgtggggcggcagcaagccgtggcccaggctaagccaacagaacgccgcttccagcgctccggcagcgccgagggtgtgaccggtcatgggtttggtcgacgagcaggctacgccatcggggaacaggctggcgaccgccaggctttccatggcgtcgttgtgttgggtggcggtgccgtgcaggttcaggtagccgatctgctcgggagccagttttgccttggccagggccttgcgcatcgcttgcaacgcgcccttgccgctgggctccggcgcggagatatgatgggcatcgcaactggcgccgctgcccagcaaggcgatcggggctggctcgcggctcatcaggaacagcaccgccgcttcaccgatattaatgccgttgcggttcaccgagaacggattgcagcgctcgctggagacggcctccagtgcggtgaaaccgttcagcgtcagcttgcacaggctgtccacgccgccgcagatcactgcatcgcagatgccaagatccagcaggcgctgggcactcatcagtgctcgggcgctggaggtgcaggcggtagaaatcacataggccgggccgctcagttgcagccagtcggcgaggaaattcgccggggcgctgagttcctgttgctggtagtcgtagtcggcggggaattgctggtcgcgcaggtagtgggcaatgccacggctggcttcgtcgatgcctgaggtgctggtgccgagcacaatgccgacccgcgaaggcccataggtttggattgcctggcgcagctgagcttcgatctgcaacgccgcttccaacagcaactggttattgcggctgctctgttggcccagcgtcaccggcaggggcgccagctcgccgtgcacggccgccaccggtaccacgcgctctggcacccagccgctttcggcgcgcatgcccgagcagtcgccggcaaacagcttgcggctgacttcggcctggccgcggccaagggcgcagatcacgccaagggcgttgaggtaagcggtcatcgtttgaggcccagcggagtaatgcgataacgcaacggctggcccgccatgttcacgctgaacacctcggaggactgatagacgatctgccaatggcccggcagcgtacgcgtcaggtccatggcctgggcgtgcggatacagcgccggcacttcatcggccgaggtcagggcaaacagcagcgcggcaaacagctcccgggcctgggggttgggtggcagcaagccgtcggcctgccactgcccatccaccagtttttgccgggccagcggaatgcccaatgggtccatcatcgaccagcgaatcgcgctgccttcactctggatcaccagcagccaatcctggctctggccgtccgccaggcgttgcacgtgcagttgcatcggcaaggccagggttggggttctttgcggcagcggtgcctggctggcacaggcgctcagcagcaacacgcaaccgatcaacagcaggcgcatcatggggcagcattctccaaaggtttacgcgctacgcagttgaccagggtttcctcgcgctggcctgccggcggcgccttgcgcaggccccagcgctccagcaggccgaagtcgctggagcggctccaccacaggtaggggtacgagacattctgcgagtcaaattcaaaaccctgctcgcgaagcatctccaggtattgctcggcgcttttctgcacatgcatcgggtggcggaacagccagcgaatcacccaggtgtcgatataggcttcggtggattcggcaaacagcagataaccgcccggcttgagtacccgataaaactccttgagtgcgcgatgttgttccaccaggtgatggaaggtctggtggcagaacaggatgtcgacgctggcgtccggtactttcagggtggcgcagtcgctgccgatcaactcgacagccatgccctggcgctcggcttcttcgcggctcagttcgaggctgtgggggtcagcatccaggccgatcaggcgtgagggcgcaaacacctcctgcagcaaccggaaggatttaccctggccgcaaccggcgtcgagcaataccggcgccaacggcagcggctcgctgaacaggctgcgcagatcgttgatcgccacccgcaacacgtgatgctgccaggtatggctgcgcaggaaccagaagccgaacctggtttcttcgacgtaattcttgctcaggtagttttttccaacggcaggactgctcataccgcttcactcgcacagatatccgacaacatccgcaaccgccgcttcggctcgctgacaaacgggttgcgctcatcccacgcgtagccagccaggatcgagctgatcatgcggcgaatctccggcgagctgccgggatggaaaatcacgtcttggaacgtgccggcataccagccttcgacgtagcaacggaaagtgtcgacccctcgtttcaagggctcggcgaattcgcgttgccagtcgacggtctcgccgttgagctgacggtgcagcacccctgcggccatgctcgccgaacgcatggcgatggtcacgccggaagaaaacaccgggtcgaggaattccgccgcattgcccagcagcgcaaagcccggcccgtgcagggttttgacgttggccgagtaaccgccgatgctgcgcgccggggtgtcccatacggcattgttgagcacgccggataagcttggcgtttcgtcgatgaagctgcgcaggcaggcgtcgaggtcgctgtcgcggccatcgaaatgctctttggccgcgaccacgcccaccgagcaacggccgttgctgaaggggatggtccagaaccagatgtcgcgctgggtcgggtgggtggtgaccagaattttgctgcgatcaaagcctgggtgtgcgatgtagtcttcgacgtgggtgaacacggcctggcgcagcggaaagttcgaaggtgcttcaaggtccagcagacgcggcagcacgcggccatagccgctggcgtcgagcacgaacttggccttgatgtggtactcgctgccgttctgtcggcgcacatgcaggtagcggcactcgccggagaaatccacgccgacaatggtttggccatagcggatgtccacgccctgcaatgccgcctgatcggccagcaatttgtcgaactcgccgcgttgcacttggtaagtggtgggcttgccgttgctgaacgtgtcaccaaaatcaaatgcactgtagcgctcgccccaggcgaaggcagcgccggtttttacctggaagcccgccgcttgcacggcgtcgagcatgcccgcttcttcgataaaatcgatgcaatgcgagagcaggctttcgccaatcgagaaacgtgggaagtgctcgcgctcaatgatcaacacatcatgccctttgcgctttagcagcgcggccgcgatggccccggatggtccggcaccgatcaccaccacctggcgacgttccatttcaactatgggcacgagggctccttgccgcatgggcgataatcgcattcataaggtgtgtttctgctgcccggcccagggcgccagcataaagctgaacgccaggccgaggctgaccgacaggccgaaattactcaccgccggtgtactagagactgccagcaggccgaacgacaaccaagtcgtcagtgctgccagcagcgtccccaacaggctgacggccgggccgccgatctgctcgcgcatcaaaatcgcatagtcaacgctgatggccgtcaccagcaacaggccgaacaggctgaaaagggtcagtggctggcccagccagccgaggctggccaggctgcacagcgcggccagcagcggcagggcgacgatacgcaaggcaccgccaaaaccaaagggcgcaatcagcaacagcacgatcagcacgcaagacatcaacttcaactcggcggcgctgatttgcgtgtcggcaaacacccggttcaagtcgcccaggcgatcgaccaattgcacaccgggcaagtccagcgcctgcacccgcagtagcgccgggttgttcaagccttgcaggctgaccatggccgcgacgccgccgtccaccgggccgagccacagcgtgcgccagggttcggcaagtgggccttgcagcgcagcgtcgatgtcggcggtgggcagctcctgcaactgcgcgacttcggcttgcagggcgctggcgggcacacccaggtccagcagcggctgccagtgttgcggcagtttgttcagcgcgtcccgcagttgttgctgttcgtccgccaggctcaccagctgattgagcgccaggtaaccctcgagcttgtccatattcactaactgatccaggcgtttgcccagggcggcttggcgttccagcaactgttgctgattgtcggcccgcaccaggaaaaactggctggtgggctggaacccggtgatgcgcgctacggcctgggcttcctggagcaattgcggcggcgcgccgatccattggcggatatcgttcttgctgttcagttgccacaggcccgcggcgcagaacaacagcacccacaccagcagcaccgaactggggacgtgcttgatcagtgcagcccgcatttgccacagcgtctgggcgatatgcagcggccattgggccgggcgcagttccacgcccttgagcagcgccggcaacaggcacacggcgcacaaataagcacccaccaacccggcggcggagaacacggcgatttgtgtcagcgccgggaacggcgtccaggccagtgccaggtagccgatgcaactggtggccaggctcaggctcagccccggcagggtcaggcgcaaggccggccaactgcgccagggttgcaggctccagcttttcgacaggtagtgcagtgggtaatccaccgccacgccgatcaggctggagcccagcaccagggtcatcacatgcatatgcccgaacagcgccacgcaggccaccgcgccaaacagcatgcccaccagtaccggcacaaacgccagcaatacgcgccagcgtcggaatgccagcagcagcaatagcaggatgccgacggtcgcaccgccgccgacccaggtgatttcccgggtggcctgccgttgcccgttggcggcatagagcaagccgctggcggcgagcagttgcgcgtcttgctcgccagcttgtgcgcgacaggcctggagcaaatccgccacgagcagcggcaatttcatatcgaaggcattgccggtagtgcgcgcccgcagcagtacccagcttttaccgtcggcttcggcgatcaaggcgccgctgccgatatccagttgcaccgagccgtgttgcggctggctgttctggatacgcccggtcaggcccagccagtcgtcctcgctcggcaccaggctgaagccggtgaacgggtcgaacagcgcttgcacccgttgctggatgaaggcgtcgggttgctcaatcagttgctcgcggtccttggccgagagcatcgacaagcgcccgcgcagcagttgctcgcgcagtgctggcaggtcggcttgcaggttccactgcactttttcaaacaagccgctggcctgccagcgctcgcccaattgttgtgccatggccagcgcttgctggcggtcggcatgccccaccagcaccagcatttcgcggttgagcggctcctgcatgcgctgttcggcttgctgttcaagggcgtccggcgtgctgccgggcaccagctccatcaggttggccgacaacggcgcgccatggcgccactgccagccggccagggccagtacggccatcagcaggattaggaacaggcgcggcagcaggcgctcactgggcaaagtcgtgttgctccgcatcgctcaggggctggctggccgtgctgtcctgcatgcgcagcacggtgctgtcgccctgggtttccagcagttcgatggtgtgcaccagctcgccgccgtcgatattgatccgggtgaacacttgcttgagcagcagcgagcgcgggatcagggtgagcttccattgctgggcctggccttgcagttgcagttcgaagtcacgctgcaagccactgctgtcgccctgcagcacggcgaggaacaggcgattctgctcgtcgccggcgctcttgttcggcagcggttgccagccgttggcgtcacgcctggcaatgccttggcctgtgatgcggtagtcctgttgcagtggggtcttgagcagccataacaggccgtggtccttggcgagcacgaaggtgcctttgctgaccagcggctggggcagggcacgcaggtgtttttcctggaggaagttgccgtggatgacggcgggttttgcaagctgatcgctcaactgctgtaagtcgaaagcctgggcattgaagctcagcaacaacgcgacccctgtaggagcgagcttgctcgcgaaaaacctgagggcgctgcgcagtgtcagttggcgcgcgttatcgttaacgtccatcgcgggcaagcccactcccacaggggatctcatttcaaggctctctctacggcgtcggtgaatactctgggcgaggcaagttgcatctcgcggttggcgatttgcaccgccacctgcacggtgctggcgcgggtcaaacgctcgccgctggccaggtcagtgatcaggtaattgaccttcaaacggttctcccactccaccaggctggcgcgcacattgagggtttggccgaaagtggcgccacgtacatagcgtagctgcatgtcgatcaccggccaggcgtagccggactccagcatggccgtgtagttatggccgatcttgtccagcaacgcacagcgcgccacttccaggtacttcacgtaatgcccgtgccacaccacgttcatggtgtcgatatcgaaaaacggcacgaggatttcagtgtcgctatgcaacacgccggggctacgcatgcagcctccaatgttgctcggcgatgcgttgcaggcacaggcgcagttcgccttccagggcgcggtcttcgatgactggcgggaagtccttggccagctctgcatgcatcgcggccaatgccggtggcagcggtcgtgcatcctcggcctgggcgcgcagccacacgccctggttggcggcgagcagggtagcggcggcgacctgttcggtcagctccagcacacggatggcgtcgcgggcggcgatggtgcccatgctgaccttgtcttggttgtggcactcggtagagcgtgagaacacgctggccggcatggtgtttttcaaggcttcggcggtccaggcgctggtgccgatctgcacggccttgaagccgtggttgatcatcgcgcggtcttcgggggcgcccgacaggttgcttggcaggccatggttgtaacgcacgtccaccagcagcgcgagctggcggtcgagcaggtcggcgacgttggccaccagggtcttgaggctgtccatggcgaaggcgatatgcccgccgtagaagtgcccgccgtgcagcacgcgttctgcttcggcgtcgatgattgggttgtcgttggcgctgttgagctcgatctcgataaatgagcgcagccagttcaggctgtcggccagcacaccgaggacatgaggggcgcagcgcaaggagtagcgatcctgcaagcgatgcagcggcgccgtcggcgcatcaatcgccaggtcgttgcgcagccaagcggcgacttgcatctggcctgggtgtggcttggcggcgaacaggcgctcgtcgaagtgctccgggttgccttgcagcgccaccacattcagcgcggtgatgcgcgtggccaggtgcagcaggtagtcggcgcgggcgaaggccaggcaagcaatgccggtcattaccgcggtgccgttcattaacgccagggcttccttgggccgcaataccagcggctcccagcccagttcgcgatgcacttcggccgcctggcgacgttcgcctcggaacagcacttcacgttcgccggacaaggtcgcggccacgtaggacagcggcgtcagatcaccgctggcgcccaccgaaccttcttccgggatcagcggcaacacatcgtgttcgaggaatccatgcaggcgctccagcagttccacgcgtaccccggacacgccgtgacacagcgactgcaaacgcgccgccagtaccgcccgggtcgcctgggcatcgagcaacttgcccaacccgcacccatgaaaggtgtacagatgacggggcagcgcctcgacatgttccagcggcaccgccaccacgcaggagtcgccgtagccggtggtcacgccgtagatcacgccttccttgtccagcaacgagtcgaggaactgcgcgcctttggcgatgcgctggcgataggcagcgtcatcctgcaactgcgtgggcgcctgacggttggccagggccagcacgtcttcgatgcgcaaagggcgttcgccaaaggttaccggctcaagatgcgtcgtcatcggtcttccagaaagggtaaaagttgaaccattgttggggcgcttgcaggcaaaactggcccaggcgtgcggcgtagcgtgcagtccactcggcaatcacttgctcgcgggtgctgcgcttccattcgatcaacggcgcgaaaggctcgatggtcaggcgatagcggccttggtgtttgaggcacatcagcaggttcaccgggcatttgagcaggccggccagcagccatgggccttgggggaaggcggcggcatggccgaggaagtccacgcgcaccgtgcgcccgccgtgcagcggtatgcggtcgccggcaatcgccagccactcgccgtcgtccaggcgctggctgagcagcagcatggtggccgggtccagttcgctgacctggatcaggcgcaaatgggtggcgccggcttcgcccaacaggcggttgaaacgctcggcgtgcttggtgtgcaccagcacgttcatggtcacctgctcaccgatctccgcgagggcgcggcacacttcgaggttgcccaggtgcgcgcccaccagcatctgtccgcgttcgccgcgcagttgcccgcgtaattgcgccgggtcgtcgatgtcgatctgctccaggcttagcttgccgttccacacatcgagcttgtccagcagcgaatcggcgaaggccatgaactggccgaagactttcctgtgggtgggatgcagctcattgcgcccactccattcggccaggcgctgctggtattgccaggcgctctggcgggcggtgcggccgaacaggaagaagtaaaaaacgatgctgtacagcaacgggctcaacagtcgacgaccaaggatttttgccgcgaccgccgtgaatttcatcagccagaagctgccacgttcctcgcggtcggcccagtgcttggtactgtcgctcatgcctgccaccgtcgccacaggatcatcggcgcacgcaccaacatgccgaagaacaagcgcgtgtgcatggcgctgatgcgaacgttgtcgcggaacaggcgaaagtgcgataagccgtcggccgggtagtgcacctgggtcggcagccagcgcatcggttggttgcgccaggccaggcgcaccaggatgtccgagtcgaaatccatgtgcgtgccgatataagccgagtccatcaaggtcagggtcggcgccagcgggtacacgcgaaagccgcacatcgagtcgcggatctgcagcgacagggtgttgatccacacccacacgtgggtcaggtagcgcgcatacaagcggcctttgggtacgctgtcgtcgtattcggggtagccgcatatcaccgcgttgggatgccggcgggaggtgtcgataaaggtttcgacttcacgcaagtcgtgctggccgtcggcatccacttgcagggcgtgggtgtagcccaggcgcgccgcctcgcggaaaccggccatgaccgcgccgcctttgccctggttgctgggcagggtcagcagggtgacgttgtccagggtcgccagttgcgccagcaccgccgcgcaggccgggctgctgccatcgtcgaccagcaggcagggcaggccgctgtcgagcagactgcggaccacagcaggtacggcggtttcatggttgtagaccgggatcagggcgcaggggttatgcatgggcggcttccagctgtatgcggccactggaacaggccgcgacgccgttgcggtaggcgaagtacagcttgcggcgttcccggtcatagcgcaggtgcagttcgatacgatcgcctgggcgcaccagttgctggaacttgagtacttccatgccggcgaatgtgctcggcaaatcgagcagttgctggcccagattgaacgcccattccacctgcaccacgcctggcagcacgggcgttaccgggaagtgaccgcggaaataggccaggtccggcgggacgctcagttgcacggtccattcgccatcggcttcgacctgctccagcacttcgggggcttttggccggggagccagcagaagtgcttcgatgtcggcctggggcagcttgccctggctgttcagcggcaattggcgcagcaaccgccagcgccggggcagggccagggcttcgcagtgttggcccaggtgctggcgcagggtttgggtgagcgtgcgccggccctggttgcgcagggcatgcaggccagccgcgctgagtaccaccagggcgccgagggaggcgcggttttcctgcaccacgcccaggcgggtttccgcaacccaggggtgggtcatcagcgcttgttccagcatcggcagggagatgcgtttttcttccagcttgacgatgcggtccaggcggcccagcaattcgaaacggccatcggcatggatgcgcgcggcatcggcggtctgctccacatgcccttcgggcaggtattttgaggcgatgcgcagcgcgccgtcggcatcctggctcagttgcacatcggcaaacggctgccagggctgcgcgccctggcgccaggcgatgccgccggtttccgagctgccgagaatttccgtcggccattgctgcaagcggtcgtataggctgcccgcggcttcaaccggcaaagcaccgccggaggaaaacactcgtgctacttggctcagcgccggccagtcgaggttgtcgcccatgcgcttgagcagcgccgggctggcgacccaggcaaatcgggggtgctcgcggctggcacgctgcatgtcctcggggaacgccagttgcttgcgcacaaaggggcggccggcgcacagcggccacaacacgcgaaacagcaagccgtagatgtgctgggtagcgacgctgccgatgacgcaggcgtctttgaggtccgcgccccacagggcttccagcgcctcgacttcattggccagttggcgcagggatttgtcgatgcgcttgggctcgccgctggagccggaggtacacaggctcaattggcaactgtccagatcaagcaccgcagggctcagtggcgcctggtacagcgcctcgaggtcagtggcttctgtcagccaggcgtcgacggcaggatcccagcgatggcgggtctggggctgcaggtcggccggcagcagcacgctggcaccggcgcgccaggcgcccagcaaggcaatcgccaggacgccggcgtcttccaggtacacggccaggcgctggatgccacgcgcctgcaggccggccgccaggcgcagtgacgcttcccacagttgggcgtggttcatgtcaggctcggtggtgacccagcgctgttgcagcggctcgagcaacaagtgctcaagtttcaacccattcatacgcggcctcgaaccctttgtcgtaccagccattccacggcaaacaacagcgccatcagcccgtaggcgatcaagccgttgtacaacgtccaccagctcagcggcgcccacagcgtgagtgcggcggcgagcaggccattacacagaaaaaatgcactccacaccacggtgacctggcgggtgtacacgattgccttcggcggcagttgcgggtcagtcatgcgcgccaggcgctcgaccatcggcgggccgtatttcaggctcaggccgaacagcgccagcatgaacgcgctgaccaggctcgggtaccagcgcaaccactgcgggttatcgaaccaggccagcagcaggcagaacaggatcaccgtcgccgccatccagcggctgcccgggcgccgcgcagccgtcagggcgcgcagcagccacaagctgcccagcagcaagccgaactgccacggtgcaaagtgctcggtgccgtaatacacggcgaagggatacagcagccccgccaacaacaggccaaggccgatcagccggctcatgcggcgggctggaccagacggtacaccgcctcaaccacatcgttcacagtgcgtacgaccttgaactcttcagcggcgatcttcttgccggtctggcgcttgatgtggtcgatcaggtccacggcgtcgatgctgtcgatttccaggtcctgatacaggttggcgtcaagggtgacgcgttcaggttccagctcaaacagttccaccaaggcgtcgcgcagggtgttgaaaatatcgtcacgagtttgcatggtacggtctcaagctgcctgtcgggccgtgacaaacgccgcaaggctggccacgttggtgaaatgattgcgggtgtccttggcgtcggcatcgatcttgataccgtaggttttctggatcgccaggcccaattccagggcgtcgaccgagtccaggcccaggccttcgccgaacaggggctgatcgctgccaatatcgtcggcgctgatgtcttccaggcccagggcctcgatgatcagctcttttatctcgtgctcaaggcggtgttggtcgctcatcttcggcgagctccttaatgaaatagtgatgcaggtaatcgttgagcttgcgtgaagcctggggcgcggggccgagcgcggcaaacgcttgtggttctatatcggcccccacgcgcaaactgaagtggaatcgacgtttgggaatgcgataccagggttcggccttggtcagggtcgtggggctgaccttgatcaccaccggggtgatgattgtcgcaccgcgcagggcaatggctgcgccaccgcgatgaaaggcaggcgccgcgccgggcgtggtgcgggtgccttcgggaaagatgatcagggtctggccggcgcgcagggcgtcggcagccgcatcgagcatgtcggcgctgccgtcgttgctgatatagccggcatcgcgcaccggcccgcgggtgaacgggttctggaacaggctctgcttgaccacgcagttggtctggcgcatgaggccgatcaggaacaccacgtcgatcagcgacgggtggttggcgacgatcatttgcccggggcgcccaagcttgtcggcgccctcgacgctgaaagtgaggatgcccagggatttcatcatgcggatgaagaaccagaacaggcaactgatggtgtggcgtgcgcgccgctggtgctgcgtggcgtcgcccggcaggcaattaagcagcggaaacaccagcaaacgcaggcacaacccgcccacgccgaacaggaaaaagctcgcggcggtggcgaacaggcgccagtagtaggcgtcccgaggcttgtcggtcagggcttgcgttgccagttccatacgcggttcttccaggcatgttggcaggcgccctgttcggtcaacagggtgcgcagcaggttcagggcatggggccactgggcggtggtggtgggttggacagtggcgctggtaagttccaactgccactcgtcgcccggggtcagcaacaggccgagggcgtaggggaacggcacgtcatcgatccaaccggcgtaggcttcgggcggctgttcttcggtgatcaccagcagcaccgccggggcgccttcattgaatagcgcggcggcttcgagcaggccatgctccaggccatcgcctgcggcggcgagggcggtcatttcactggtttcattgcgcaggatcgaccacaggccaatcactgcgttgtgcaccgacaggctgaattgggtcggtgacaggggctgatcgttggccaggtcgctgaggatatcgagggtgcgcggggtttcgccgtgccgggagataaacaccaggggcaaatcctgcaaaccctcggccaatggccagcccacactgaaggccatgcgcgccaggcgactgaggcggcggcgttgcatcgctggcaaaaatgacacatccggcgagtcttcacagacaggcagcaacaccggggcccggcaccagccgtgccagtcgtccgcggtctccaggccaggagcccaggcgcgccattgggcgatgttgaagttgatcactgagaagatatcccgcccctgcgggcttccatgtgcggccggtagccccgaataccgggataggcagcgatggccgaatggcgcgcattatcccggtgccgtggggttctagcaaactttggtaaagaattgttcaagtctgattacaaattagtgggcaggaatgacagattgtcccttactcaggcgcgacttggattgtcggaccgttcctatccatttgtgcgtgatgtactaaggcttactggtaatgcagcagtgcatggatgaacgaggtagctaacgggcgcttttgcgctctacactcgggcattcattgatacacggaggtttttccatgcggcgcgtggtgttcaatcagaaaggcggggttggcaagtccagcatcgcctgcaacctggcggcggtcagcgccagcgaaggttaccggaccctgttggtggacctcgatgcacaagccaactcgacccaatacctcaccggcttgaccggcgacgatattcccatgggaattgccgactttttcaagcaaaccctgtcttccgggccgttttccaagaagaacaaggtggatatctacgaaacgccgttcgacaacctgcacgtgatcaccgccaccgccgagctggcagacctgcagccaaagctcgaagccaaacacaagatcaacaagctgcgaaagctgctggatgagttgagtgaggattacgaccgcatttacctcgatacgccacccgcgttgaacttctatgcggtttctgcgctgattgcggctgaccgtgtgctgatccccttcgattgcgacagcttttcgcgccaggccctgtatggcctactgagggaaatcgaagaattgaaggacgaccacaacgaaggccttgaagtggaaggcattgtggtcaatcagttccaggcccgggccagcctgccgcagcagatgctggatgagttgatcgccgagggcctgccggtgctgccggtgtacctggccagttcggtgcgcatgcgcgagtcgcaccaggagagcaagccactgatccacctggaccccaggcacaagctgacccagcagtttgtggaattgcacaatctgctggaaaacgcctgatctcaagtgccacacagatccaatgtgggagggggcttgctcccgatggcggtgtgtcagtcacctgataagttgactggcctactgctatcgggagcaagccccctcccacatttggatggtattccaatgaatcgtcccacagaggctgtaggaccggtctggcaataaggcttgtgccttgtaaccttgcctacaggtacgccagaatccgccggcttgtgcgtctggatgggcgtctctaaggtttgccggtcgctgaatgttcagtgatcgggtttagtagcccgtggtgagacgtacggcaattcgtcgatcaggagcgtcctgaacttgatggtggctgtacggagggcgctttcgagcgcgccggttgcgtctccccggtctactaacctgcgtacagctgccaccctccgtttagtagcggtaggttgcggctcctctactcggagacgatccatggttaacctttataccgttacacccaacctccccaccgaagccctcgtgctcaacagctacgaaaccttctcctccgtgcgcacgctattactcaacttgtccaacgacctcactggcgaacatcgcgatgtggcgctggcgattcaccaattaagcgaactgggcgtcatgctggtcggccagatgatggaccgagaagccccactgccccaaagctgaaacacggtcaaaaatgtgggagggggcttgcccccgatagcggtgtgtcagccaatccatgtggtgactgacacactgcatcgggggcaagccccctcccacactgtccggtgttgtgctgatgatctggttatacgccctggctacgcaaccagctcatcaactgcggcaacgggaatgccccactctggcgcgccacttcgcgtccgttcttgaacagaatcaaactgggaatcgaacgaatctccaactgcgccgacagctgctgattggcctcgctgtccagcttcgccaaccggcacttaccttccagctgcccggcggcctgctcgaataccggcgcaaacgacttgcacggcccacaccaagccgcccacacatccaccagcaacggcaaatcgcccttgatctggctggcatagtcgccttgtttcaattcaaagggcttgttcaacaacaccggctgcttgcaacgcccgcatttgggcgcatcacccagacgttcgccggggatgcggttgagaccgttgcaatgagggcaggggattacaagtggttcggacatcggaggctcctggagtctggccaatagatgtatttggtgccgggagtggggtttatcaaggttagatacagcgacttattcgctcacattttcgcccgctccgggatgattcgtgtagctaggctttttgttgtgcgccaccggtctgtttgcggctatagcaaattgcgatagttcgaattcaggtttaaccttcatagcaagatgcgataaggacgttgcatgcgagtcatcagtgaaagcaggatctgggaagcaaagggaaaatggccgcgctcggcaacggctctggatcagtggtatcgcgtgatcaagcgcaacgcccccaaggactttgctgcgatgaaagccatgtttccagccacggacaaggtaggtgaatttcatgtgtttgatattggcggtaacaagctgaggttgattgcgtcggtgcagtatcgaatgcagcgcgtttacatcaagcacctgcttgaccatcgcgattatgagaaggacaaatggaaggaaaaaatcagatgagcgcacttatgcgagtggcggcagagcactggcaattcgtttcgcctgtgctgcgcaagccggaaaacgaggcagactacgacgcactggtgtgcggtttggatgagttgttgagcctggtgggtgaagacgaggacagcccgctgatgagcctggtcgacattctgagcgactggatcgaagcttatgatcgcgagcatcgcccaatgcccgtcgccagcggggtcgatgtgctgcgctacatgatgcgcgagcacaacctcacccagagcgaccttccgggggttggggcgcaatcagtcgtctctgaggtattgagcggaaaacgccagctcaacgtgcgccagattcgttggctggccgagcgttttggggtgtctgtggagacctttatctaagaggtcaagacgaacaactgatctccaaatgcttgccccaatccggcggccgctgcgcgtattgctccatccccgcttgttcctcaaacggtttggaaagcacctcatgcagccgtcgcacttcgctgtagtcccccgcctcggcggcggcgatggcgttttgtgccaggtagttgcgcaggatgtacagcgggttcaccgcatgcatgcgcccacggcgctgctcctgagtgtaatccccgtcccgcgcaacacgagctatgtaccgctcggcccaggcatcgaacccagccaggtcgacaaagtcgtcgcgcaaccgcttcactgcaagctccgcggactcatcgcccaggcgccggaagaacagcgtgtagtccacgccactgttctgcatcagcttgagcaagccttccaccagtttctggtcatcgtcttcggcagtggtcagccccagccggcggcgcatcaggtccaggtaatgggcctggtagaacggcaggtacaggccaagtgcctctttcaaggcgtcgacgctgataaacggcgtaagcgcctgggccaatgcgctgaggttccactgcccgatcggcacttggttgctgaaggaataacgcccttcatggtcggaatggttacagatgaagtgcgcgtcgaaatcatcgagaaacgcaaacggcccgaagtcaaaagtaatgcccaggatcgacatgttatcggtgttcatcaccccgtggcagaagccatacgcctgccatttggcgatcatctcggcattgcgctcgacgatttcgcggaacatcgccaggtacggttcaggctgctcgcggcactcggggtagtgcaggttcagcacgtgcttggccagctcggcctgctgttcgggcttcttggtgtagtagaagtactcaaaatgcccgaagcggatatggctctgggccaggcgcagaaccatggcgccacgctcctgtttttcacgccataccggggtgctcgagccgataacgcacagggcgcggctgctggggatgcccagtgcatgcagggcttcagaggcaaggaattctcggatcgatgagcgcaatactgcacgcccgtcgcccatgcgcgagtaaggcgtcatgccagcgcctttgaggtgcaaatcccaatgttcgccggcctggttgtagacctcgcccagcaacaatccgcggccatcgcccaattgcggggtgtaaccgccaaactgatgcccggaatagaccatcgcccgaggttctgcctcggcccacaacttgtggccgccaaacagctcggcaaataccggtgtttcggccacggccgggtcgaggtcaagcagggccatggcggccttgctggccaccaccaggcgcggttcgtccagcggctctggcagcacgtgagttgagaacgcgtcgcccaggcgtgcgaagcggttgtcgaaggtcagttcgtcgagggctttcaccggccatctccagcagaatgtccgagtattctgctggggatagggcgtttagtcgagtttgctcggtggcggctccggcgcatccaccactttgcctgcgggaggctccggtgcgtcgggcttgtcgacgggctcgacgatggtcttgcgctcgtcctcggccggcaccagtttgtattcctggccgtggaggtttttcaggtagatctccatctgcctgaacgagatgttgatgtgctgtttcttgaactcacggttgataaagcggttgacctcgtccagcaccgggttgcggtcgcccaggtcgcgtacgtgcatgcgcaactcgtggtccagggtgctttcgccgaagttgaggaagtacacgtggggttcgggctctttcagtacccgtgggttttcccgtgcggctttgagtaacaattccttcaccaggtccaggtcggagccgtagtccaccccgagttttagggtcacccgagtgatggtgtcggtcagcgaccagttgatcagttgcccggtaatgaaggttttattcgggacgatgatgtccttgttgtcgaagtcggtgatggtggtggcacgaatgcggatcttgctcaccgtccccgacaggttgccgatggtgatggtgtcgccaatgcgcaccgggcgttcgaacaggatcatgatgccggagatgaagttggcgaagatctcctgcataccgaaaccgaggcccaccgacagcgcggccaccagccattgcagcttgtcccagctcacaccgagggtggagagcgtggtcacaaagcccacgccggcaatgatgtaggacagcaaggtggtggtggcgtaggcgctgccctgggccaggtccagcttggacagcaccagtacttccagcaggccgggcaggttgcgcgccagggcgaaggtgatgccgatgatgatcgaggcgcccagcaggtcgccgatgctgatgggcaccatgctgatattcgcgcccgtaccgctggtgtattcgtacagggtgacgttatccaggtatgagaataccgagatcagatccgaccacacccagtacaacgccgcgatgaagccgccgagcagggccagtcggatcaggcgcaaggattgttcattgactttttcgatgtccagtgtcggctcttccaccacggattcgccttcaccggcgtccttggcggcctggcgtttggccagggcccgggcgtaggccaagcgccgggcggcgacgcttagccagcgtacgaaggtggcctcgatcaccagccagaacatcagcaagtacagggtgttgatcagccggtcgctgagtttcagtgcggtgtagtagtagccaaagcacacggcaataaacagcgcgaccggcagggcggtgaacagcagcccgatggccttacgaaacaatgaggctttttcgtgggtcgggctgttgagcagcaggcggctcagcaaccatgccatcagcgcgtagcaggtgagcactacggcgatgcccagaacgtcttcggccagtgccgccggctgatgttcggcaatcgcaaccacggccaccaaggccaataccacgaggccgagcttgcgcacccagccttgcaggaactcgacttggggcttttcccaacgaaagtgcagttcggctacgccgcccggcgccaggatccggtaggcggtgtagaacaccagccacgcctgggcgatctgcagcagggccgagcccaggttggcgttttgcccgcgggcgtcaatctgcagcgcatagccgcacagcgccaggcccagggccaccggcatggccagcaggacattgatcaggatggcctggggcgtgtgccactggctgtcgcgcttgaagtggccgatgtccaggtgcaccttcttcagccgtacatacagcgcattacggcgccacaatagcgcgccgatcagcagcagcaacggcaggaacagcagcgggcgttgggtgaggccgtcatacaactcgctgacgctggacgcccagggtaaggtggtgacctgcttgctcaagtgagccggcacggtttccagccactcggtgtccaacggcttgttgctcgggatccagaacatctgttcgtcgagcgtcgcccgcagggtggtggcggtgctgagcagttgtttctggttcagttgcagggtgatggattcattgagcagtgcgctcaactcgcggctcaggcgttccagcaggtcactgcgggtgatcgccagctccagcaaggtacgccgcagttgcggggtgacttcatccggcggctggtcggccagcagcttatccacgtaggcactgggggagctgatcagctcgcgctgctggttgacctcgaactggtacaggcgaatgttggcgatatcgtcggccaggtcgcggtcgacggtaaggcgtggcagggcctgtttctgcttatacagaatcttggacagcagcaggctgcccttgagcacgttgatctgctcgtccagggccgaatcgctctgggtcacggtgtccagttgctgcttggtctgcaggtttttctgggtcaaatcgttgaggcggtcggtgcttttgagcaggtaatcggagagcttgaggttcgccgcgctttccgtggccaacaggctgctgccaccggctttctgcgcttcgatggactgttgggtgacggtctgttgggattgggccaggcgtttctggttgatcagggtttgcaggtcctggatttcctgctccaggcgcgcggttttctcctggatcaggtcatgctggctgttgcctaggtcttgcagttggctgttgccggccaattcctggcggcgtagggggatcagtgcattcagggccgccagttcagcgttcaactggttgcgctggtcgccgctgagagccttgccattatctttgccgagtttgagcgtggcgttgatctgctggatgcgcgtctggctgctgctgatttcggtctgggcgcgctcggggcgggtctgtgcggcgatggtcaggctgttggcctcggccagctctttttgcagatcgccttgctgggtggtgcgttgtaccagcaattgctcgagctgcggcaccggcagggtggcgtagcgttgggccaccgggatgaccttggtggccttgagccgggtcagctcgcgttggttctcggtggtctggcgcggagcctcttccagctggcgcttgaggtcggccaggcgttgttcgtaatcctgcttgttgcccaggtaggtcagggtctgctgcaggatcgcctgcaacgccttcatgtcggcgtcgggcagcttgcgatcgggcagtttatccaggttttgctggatggcgtcggcgctgggcgggtcggcggcgtatacgctgccgacacaaagggtcaagcccagcagggcagtggcgagaaaagtgcgcagggttggcatagagaccggtcttgcaaggtgaagaatcggggcgttattgccccgcagtttagaggaagagtccggggcccgggcgacttccttcggggaatctgacgccgactttgccaatcttgttcccgtccatgaccgcgacggtccagatggtgttgttccattccacctggtcgcccactaccggcgcgccgccgaccttctgggtaatgaagcggctcaatggcatgtccgggtcgataccctccagcttgagcccgtacagggccgaaaccgcgcccagctgggcatcgccttcgagcacgaagtcgccgaagaagcgcaggtcgaggccccgttggggtgcctggctgaacagtttgccaagggccggcaggttgtgttcgtggccgatcacacagagcagatcgtcgacttcaagcaccgtactacccgacggatggagcagttgctggccccggaacagcgcggcgatgcgcgtgccttcgggcattttcagctcgcgcagggccgcgccgatgcaccatttttccgcgcccaggcggtagacgaacagctcccactcgctggtgacgtgcacttccagggcggcccgggaaatcggggctgggtccggcggtacggtgaccttgagcagcttggccacccatggcaggcttgtgccctgcaccagcagcgacaccagcacgataaagaacgccaggttgaagtacagctgcgcatggggcaggccggccatcagcgggaacaccgcgaggatgatcggcaccgcgccgcgcaggccgacccaggcgataaaggctttttcgcgcccgtggaaggccttgaacggcaacagcccgaccatcaccgacaacggccgcgcaaacaggatcatccacagcgccaggcccagggctggcagggcgatgggcagcaggtcatggggcgtgaccaacaggcccagcaccaggaacatgccgatctgcgccagccaggccatgccatcgagcatatgcaaaatgccatggcggctgcgcaccgggcggttgccaatcaccaggccgcacaggtacacggccaggaagccgctgccgtgcagggcgttggtcagggcgaagacgaacaggccgccggcgatgaccaggatcggatacaggccgttggccaggttgatacggttgaccaattgcaacatcagccagccgccgcccaggcccaccaggccgccgatgccgaattcgcggataaggtgcgtcagcaggctccagtgcaggccggtctggccgctggcgagcatgtcgatcagggtgacggtgaggaacaccgccatcgggtcgttgctgccggattcgatttccaggctggcgctgacccgttcgttgaggcccttgccgcccagcagcgagaacaccgctgcagcgtccgtggagccgacgatggcgccgatcagcaagccctggatgatattgaggtcgaacagccaggccgcggccatgcccgtgaggccggtggtaatcaacacccccaccgtagccagggacaaggccggccacagcgccacacggaagctcgccacccgtgtgcgcaacccgccgtcgagcaggatcacggcgagggcgaggttgcccaccaggtaggcggtcgggtagttatcgaaaatgatgccgccgccatcgacgccggcggtcatgcccacggccaggatgatcaccaaaatcgggatacccaggcgggacgaaagggagctcaccagaatgctcgcactcaccagcaacgcgccgatcaagaacaggctgttgatggtcgtcgcattcaaaggcagtactccagagcaaggaagacggggcgcaaactgaccatgcagtctgcgtgccagggattctaacctgttgaaatgctgcgctgtcaaaaagctttttctgatttgcgcaaaagcaaatgtggaaggtgtaggagcgagcaagctcgctcctacaaaggggggcgggcttcagggttatagacggaagcggcctaccatcccgttcaggtccaccgccaggcgcgacaattcgctgctcgcggcgctggtctggccggcgcccgtagcggattgcaccgacagatcacgaatgttcaccaggttacggtccacttcccgcgccacttgcgcctgctcttccgccgcgctggcgatgaccaggttgcgctcgttgatctcgacaatcgcggtgttgatggtatccagcgacatgcccgcgcccttggcaatgttcagcgtcgactcggcccgctcggtgctgttgcgcatcgaatccactgcgtgctcagtaccggtctggatgctgccgatcatgcgctcgatctcgctggtggattgctgggtgcgatgagccagggcccgcacttcatccgccactacggcgaaaccgcgcccggcttccccggcccgtgcggcttcaattgctgcgttcagggccagcaggttggtctggtcagccaggccgcgaatcacgtccagcaccttgccgatatcccgcgattcattggccaggtcgccaatcagcgaggcggtggcttgtacgtcggcgctcatgcgttcgatggcactgacggtttcctgcaccaggtcacgaccatcaccggcggaggtggtggcgttgcgcgaggcctcggacgtgctgaccgcattgcgcgcgacttcttccacggcgctggtcatctcattgacggcggtggccgcctgttcgatttcattgttttgctgggtcaggccacgggcgctttcgtcggtgacggcgttcagctcctcggcagcagaggccagttgcgtggcggagccggcgatgcgttgcagggtgtcgcgcagcttgttttgcatcttggccatggcggccagcaggcggccggcttcgtcgttgccgtctacggtgatcgggcgcgtcaggttaccttcggccacttcttcggcggcttcaagcgctcgggcgatgggcagggtgatgctgcgggtcagcagccaggcgaacaacacggtcagcgccgtggcaaccaccagcaggcccactaccaggtcaaaggccatttcgtactggtctttggcttgctggttggtggcgttggcgtcgtcgttgttgatatccagcaaacgggtcaatacagcgttgacctgctcggagttgctcagcaactcggtgttcagcaagttgcgcagctcgtcgatctgattggcacgcgacaggctcttcatgcgctcttcaatctggtggtactggcccagcaggcgcacgtactcgtcgtaggcgttgcgttcttgcgtactggtgatgagtttttcgtagacgccctgggccgtgcgaatctgctgattgcgcaactcaaaggcttccagggttttttgctgcacctcaggctcgcggttggtcagcaaacggtacgacaacacgcgcaagcgcagggtcagctgggtgaactcgtcgagggcacgaatgctgggtacgctggccgaggtgatgtcttcggtggctgcgcggatcttgctcatctggttcagggcgaacacaccgagcaacaacatcagggcgccaataaacgcgaagccgaggaaggccctcggggcgatattcatattacgaagagacatgctggaatcctggggagaagcgcgatccatgcggccatgggacgaggtgtgcctgccttatcggccatgggactaaagtcttaaggggccgcgcgcttttgtcgcatctgacgaggggttgggacgattcaggaaccagatcgggtaaatgcagtcactaaggctcgaaagtgcggcccgcccctggataatcgggccgcacgccggggataaccctggcatccgaggtgaattttctttatcgtcaccgcccttttaaatgcccgagaaatcaaaatgttagaagcatccctcagtcaattggaacaactggtcagcgacctcgtacagcagaatcaagagctgctgggcagcaacgaatccctcaaggccgaactggcccgtgccaaggatgaaaacgacagcctgcaactgaacctgatggagcaggaagaaaagcacggcgccaccgccgctcgcatccaggcactggttgagcgtgtgagcgcagggcctgtcagcgcatgaatgaagggataaaggtcgtttcgattctcggagaggattactcgatcaaggcaccggccggcgaagatcagaccctgatgcacgctgtgaccatgctcaaggcttccctggcagtgaccaagaaaaagtacccgaccctgatcggtgacaaattattggtattggccgcgctgaacctgtgcgccgagcagatcgaaatgcagcaagcgcaccagcaggaactcgaccgttaccaagagcaagtcagcgccacggttgatgtgatttccaaggtgatcgggcagccctagaaccagtcgtcttgcatccccaggcacgtatcgtcgcgtgcctccagaatcgccagttcatgatggcagcctggtacttcccacgtcagaaagtaccgggcagcctggagcttgcccttatagaaggccacatcggctgcattgcctttgaccagcccttcttcggcgcggatcgcctgttccagccagcgccagccgatcaccgtatgcccgaacaccttcaagtacagtgccgagttcgccaggctgctgttgaccttgccctgggcgagatcggtcagcaggccaatggtgacgctttgcagtcgattaaccagttgctccaatggctcccttagtgccgtaagtgacgggtgctgctgcgcccgtgcaccggtctcggcgatcaagcgaatcaactgtttcaaaccggctccaccgttctgtgccaatttgcgcccgagcaagtccagggactggataccgtgggtgccttcgtggatcgggttcaagcggttatcgcgatagtactgctcaaccgggtattcgcgggtgtagccatggccgccgaggatctggatcgccagttcgttggccttgaggcaaaactccgacggccaggatttgacgataggcgtgagcagatcgagcagttcgtgggcttgtttgcgctcgacgtcggagggcagggtggtggtgtcatcgaacagccgcgccgcgtacagaccgaggtcgaaggcgccttccacataggctttctgcgtcagcagcatgcgcttgatgtcggcgtgctggatgatcgacaccggcgcggtgctcgggtccttgctgtccggcagacggccctgtgggcgttcgcgggcgtactccagcgagtaaaggtagccggcgtaaccgagcatcaccgcgcccatgcccacgccgatgcgcgcctcattcatcatttggaacatgcaactcaaaccctggtggggtttgcccaccagatagccgacacagtcaccgttatccccgaagttcagcgcggtggacgtggtgccgcgccagcccatcttgtgaaacagcccggccagcaacacatcgttgcgagcgcccaggctaccgtcatcgttgaccaggaacttaggcacgataaacagcgaaatacctttcacgccggcaggggcatcgggcagcttggccagcaccatatgcacgatgttttccgacagcgagtggtcaccgccggagatgaagatcttgttgcccttgagtcgataactgccgtcagccgcaggttcagcgcgggtacgaatatccgatagggatgaaccagcatggggctcggtcagggccatggttccgaagaaacgtccttcgatcatcggttgcaggaagcgttgtttctgctcttcggtgccgaagctttcgatcaggttggcggcgcccatggtcaggaacgggtaggaggtcgatgcggcgttggccgattggaagtgggcgaagcacgcctgggacaacagtgtcggcagttgcatgccaccggcttcgaaactgcgtgcggcgttgaggaaaccggcttccaggaaggcatctacggcgggtttgacctccggaatcaggatggcctggccgtcttcatagcgcggttcgttttcatcgttcttgcggttgtggggggcgaagtacttttcggcgatgttgcgcgcggtgctaatggctgcatcgaaggtttcgcgattgtgttcggcaaaccgctcgcgctgggtcaggccctcggcatcgaggacttcatacagctcgaaagccagattgcgggaactgagcagcgactcggacatggcggcttacctttggaggaattggcctgagtctaagcgcgtgaatataggctggatagcaagattgatctgggtgatggaagggcaaaacgcaggcaggtaattgaagtgcagtcaatgtgggagggggcttgctcccgatagcagtgtgtcagtgtccaatgtgctgactgacactccgctatcgggagcaagccccctcccacaggttttaaccgatagtcatcaggctggcgttaccgcctgccgctgcggtgttgacgctcaacgcccgctcgatcaccaatcgctccaaggcaatggccgtctcaccctgagacataccatgcaccccaacaatcgccccaccacgctgcgccacttgctggcataccgcacgcaattggtcggaatcgccgtggtgcaggacggcatcgaacaccacgtcgtctttggtccagtcagccacgcgcttgatcttcgcctgaatatccttcggcaggcgtgcgaacaacgctttggtcagctcggtttccggccataccgccgagccgcctaccgccaacaccgccgccagttgagtgagcaagtcgccttccacttcagccaggcacagcacgtgctcacgcggcaggatggcatagctgttgcgctcaccggtcgggccggccagttggcgggtgataccgctttgcgactgcgtggcaaactgcgtgcacagcgcgctcagttcactgaacttattgctgtcggcccaggacttcagagaggtcagcgcttggctcatggcatcgcgcagccgtacatccggcgccgccaacttgtcaccccgtacaaaggattgctcgattgcatcggtaggacgagtcgacagcaggcggtacaggtacagcgggccaccggctttcgggccggtgcccgacaggccttcgccgccgaacggttgcacgccgaccacggcacccacgatgttgcggttgacgtagacgttaccggcattgacgttgtcgatcaccttggcgatggtttcgtcgatgcgggtgtgcacgcccagggtcaggccgtagcccgacgcgttgatctggccgatcaactggtcgatctctttgcgcttgtagcgcaccacgtgcagcaccgggccgaagatttcccgttgcagctcgtcgaagctttccagttcgatcagggttggcgtcacgaaggtgccgcgcttgatctcttcaccgtcggcaatcgccacctggtacaccgtgcggcctttatcgcgcatggcctggatgtgtttttcgatgccggccttggcttcggcgtcgatcaccgggccgatgtccaccgacaggcgctcagggttgcccaggcggcattcagccatggcgcccttgagcatttcgatcacgcggtctgccgaatcttcctgcaggcacagtacacgcagggccgagcagcgttggccggcgctgtcgaaggccgaggacaccacgtcgatcaccacctgttcagtgagtgccgacgagtcaacgatcattgcgttctggccaccggtttcggcgatcagtgggatcgggcgaccctgggcgtccaggcgcccggcgacattgcgttgcagcaggcgcgcaacctcggtggaaccggtgaacatcacgcctttgacgcgatcatcacccaccaggcgggcaccgacgctttcgccttggcccggcagcagttgcagcacgccttccggaatgccggcttcgagcaggatgcgcacggcttgggcggcgaccagcggggtttgttcggcaggtttggccagtaccgggttaccggcggccaatgcagcagcaacctggccgctgaagatggcgagcgggaagttccacgggctgatgcacaccactgggcccaatgggcgatgggcgtcattggtgaaatcgttgcgcgcctgcaccgcgtagtaacgcaggaagtccacggcttcacgcacttcggcgatggcgttggcgaaggtcttgccggcttcgcgggccagcaggcccatcagcggctggatctcgccttccatcaggtcggcggcacgctccaggatcgcggcgcgttcggcgggcggggtggcctgccagatcggtgcggcgctgatggcgcactggatcgcgttgtcgacatcttcgacggtggcttcctgtacgtggccgaccacatcacgcagatcagacgggttcagcaccggctgggccgcttcctggctggaggcgcaaccgagcatcggcgcggctttccagttgttgtgggcggtagccagcaaggcgcaggacagcgacgccaggcggtgttcgttggccaggtcgataccggccgagttggcgcggtcgctgccatacaggtcacgcggcagcggaatacgcgggtgcggcaagccgaagccaccttccagcgtagccatctgctcgatgctggccactggatcggccaccagctcctggatcgagatcgattggtcggcgatacggttgacgaatgaggtgttggcgccgttttccagcaggcggcgtaccaggtaggccagcagcgtttcgtgggtaccgaccggcgcgtatacgcggcacggacggttcagcttgccttcggaaaccttgcccaccacttgttcgtacagcggttcacccatgccgtgcaggcattggaactcgtactggccggggtaatagttctgaccggcgatatggtagatggccgacagggtatgggcgttgtgcgtggcgaactgcgggtagatggcttccggcaccgacagcagtttgcgtgcgcaggcaatgtaggaaacgtcggtgtacaccttgcgggtgtagaccgggtagccttccaggccctcgacctgggcgcgtttgatttcgctgtcccagtacgcgccttttaccaggcggatcatcaggcgatggcggctgcggcgggccaggtcgatgacgtagtcgatcacatacgggcaacgcttctggtaagcctggatcacaaagccgatgccgttccagccagtcagttgcggctcgaagcacaggcgctcgagcaggtccagggacagctccaggcggtcggcttcttcggcgtcgatgttcaggccgatgtcgtattgcttggccagcaaggtcagcgacagcaggcgcgggtacagctcgtccatcacacgctcgtactgtgcgcggctgtagcgcgggtgcagggcggaaagcttgatggagatgcccgggccttcatagatcccgcggccatgggaggctttgccgatggagtgaatggcttgttcgtacgaggccaggtacttctgggcatcgtgttcggtgagtgcggcttcaccgagcatatcgtaggaataacggaagcctttggcttcgaacttgctcgcattggccagggcttcggcgatggtttcgccggtgacgaactgctcgcccatcaggcgcatggccatgtcgacgcccttgcggatcatcggctcgccgcttttgccgatgatacggctcagggacgaggtcaagcccgcctcattatgggtagcgaccaatttgccggtcagcagcaggccccaggtggcggcgttgacgaacagcgacgggctgttacccaggtgcggctgccagttaccggtgctgatcttgtcgcggatcagcgcgtcacgagtgcctttgtccgggatgcgcagcagcgcttcggccaggcacatcagtgccacgccttcctgggacgacagggagaattcttgcagcaggccttggacgataccggcacggccaccggcgctcttctgattgcgcagtttttcggcaatcgaggcggccagtttgttggtggcttcggccatttcgaccggcaggcgcgcctgctcgatcagcatcggtaccacttccggctctgggcggcggtaagcggcggtgatcgaggcgcgcaggaccgattgcggcaggatgctttcggcgaactccaggaagcattgatgggcgtgatcggcctggatctcgcctgcgtcttcggcgtccttgctgcccgaaccattgagctcggacagggttgcaccaccctcgagtttctccaggtaattgaaaatcgcctgtttgatcagccagtgcggcgtgcgatcaattgaggtcgcagcggccttaaggcgttcgcgggtcgggtcgtcgagtttgaccccaagggtggtcgttgccatctttttatcctcatgggtgccactaccgagtggcatctgctggccgcaagattagctttgcccatgcgcaggtgcaaccgggtgcaacccttttgttcaggaaattttcgacggttgatcggaaaaaatatggcccacggccgaattcgctttgcattggtgcatttgcttctgagatccgctgttcttgctccgaaaaggagcaaaaacagggcgtttatccagaaacacacttgggtgcaacttattcgaaagaaactggttgcaccttatttgctttgttgaatagcattcgcgcaccaaggtgcaaccatctctaggggtggttcatcggctggcggctttcctggggaaacgccagtcataaatgcgcggcatgcgggctcgtctatccggttactgaaccgatggtcgtccgactgaccgtcgctacataaaaacaaagccagggcgtcactcctatgagcgttagcaatccaaccctgatcacgttcgtgatctatatcgcagcaatggtgctgatcggcctgatggcctatcgctccaccaacaacctttccgattacatcctcggcggtcgcagcctcggtagcgtggtaacagccttgtcagccggtgcttccgacatgagcggctggttgttgatgggcttgccgggcgcgatctacatgtccggcctgtcggaaagctggattgccattggcctgatcgtcggtgcctacctcaactggttgttcgtggccggccgcctgcgggtgcagaccgaacacaacggcgacgccctgaccttgccggattacttctccagccgcttcgaagacaaaagcggcctgctgcggatcatctccgccgtggtgatcctggtgttcttcaccatttactgcgcttccggcatcgtcgccggtgcccgcctgttcgaaagcaccttcggcatgtcctatgagactgcgctgtgggccggtgctgcggcgaccattgcctacacctttatcggtggtttcctggcggtcagctggaccgacaccgtacaagccacactgatgatcttcgcgctgatcctgacgccgatcatcgtgctgctggcgaccggcggtgtagacaccaccttcctggctatcgaagccaaggacccgaccaacttcgacatgctgaagaacaccaccttcatcggcatcatctcgctgatgggctggggcctgggttacttcggccagccgcacatccttgcgcgtttcatggcagcggattcggtgaagtcgatcgccaaggcgcgtcgcatctccatgacctggatgatcctgtgcctgggcggcaccgtggcagtgggcttcttcggtatcgcctacttctcggcgcatccggaagtggcaggcccggtgactgaaaaccctgagcgtgtgtttatcgaactggccaagctcctgttcaacccatggattgccggtgtattgctgtctgcgatcctggcggcggtcatgagtactttgagctgccagttgttggtgtgctccagcgccctgactgaagacttttacaaagcgttcctgcgcaaaggcgcttcccagcttgagctggtatgggtcggccgaatcatggtgctggtagtggccttgatcgccatcgccatggccgccaacccggaaaaccgcgtactgggcctggtcagctacgcctgggcaggcttcggcgctgcgttcggccctgtggtgctgatctcggtgatctggaaaaacatgactcgcaacggcgcactggccggcatcctggtcggcgcgatcaccgtcatcgtgtggaagcacttcgaactgctgggtctgtacgaaatcatcccaggcttcatcttcgccagcctggcaatctacttcgtgagcaagatgggcgcaccgactgcgggtatggtcgagcgctttgatgcggcggaaaaagactacaacctcaacaagtaaatcctagggcgtttaacgcctgttgaacgagtgaaaaaggcccgcgtcctgaggatgccgggcctttttttgtgcgagccttcggctgctgacgaatgaagccaagggtaggaccttactgatttgcctgcgaggagtcctggccggcaacaagctggtgcagaatcgaccgcccacccttcgcagagaaacaccggatgttcgctcctgccaatcaaagtgcatttaccctggcccttgatggggtgcccagcgacttaaaggtgttcaagttcagcggcaccgaggccatcagccagccttaccgttttgaacttgagctggtcagcgagcaaccggatcttgatttggagggcttgctgcatcgccaggtgtacttgagtttcaatgagcagggccatggtgttcacggcttggtttatcgggtcgcccagggcgattccgggcggcgtctgacgcgttaccagctcagtctggtgccgcacttggcgtacctggcgcatagcagtcaacagcgtgtcttccagcttaagacggtgccgcagatcattgtgcaggtgttggtggggcaagggattcacagcgatcgtttcgagttccggttgagcggccattaccctgagcgcgaatattgcgtgcagttcggcgagaccgacctggcgttcatccagcgcctgtgcgccgaactgggcattcactatcacttccagcattcgcccgaagggcacctgctggtgttcggcgatgaccagacggtgtttgcccaggcggatcagcccacaccttaccgacccggttcgggaatggttgccgatacccctgcaatcaagcgtttttcgctgcaactggcgacctgtgccacggcggtgaacctgcgcgattacgattttcaaaaaccgcacctcgagatgcaagccacggccgctgacacgccgtcgccgaagcttgaaacgcagcaattccccggcgctttttccgaccgggtccatggcaaatatcttgcccagcgtagcttggagcggcatcgcagcggctaccggatcgcacgcggccagggggatgagccggccttggccagcggtaggttcctgcagttgagggagcatccgtgcgagggctggaatgacttgtggttggtaacgcacgtgacccatgagggcaagcagccccaggtgctggaagaggcggtcaccgaggtggctggcggggagttccgccaggggtactgcaatgcgtttgtcgccacaccctgggatgcgatcttccgcccgcccttgcctgagcgtccacgtcccagcgtatcgggttatcaaagcgcagtggtcacaggcccggttgacagtgaaatccattgcgacgagtacggccgggtcaaagtgcagttggcctgggatcgcgtcggtgagcacaacgagcattccagttgctggttgcgtgtcgccagcgcctgggcccatgaccgctatggtgcggtgctgatccccagggtcggtatggaggtgctggtaggtttcgtcaatggtgacctggatatgccgctggtggtggggtgcctgcccaatgccgccaagcgggtgccgctggatctgccggcagacaagacccgcagtatcttgcgtagccagagcagcccgggcggtggaggctacaacgaactgcgtatcgaggatcgcaagggcgccgaagagatctacctgcgggcccagcgggactggacccaacatgtgctgcacgaccagcaagtgcaggtcgataacctgcggcgcgtgcgagtgggcggcgagtcgcaccatgagttgcagggtggggagcagcgcatcacccatggcaatcgcctggttgaactcaagcaggatgaccatctggtggtcggcggttcacagcatctgcgtgcggggcagactgtccagttgggggcggggcaaagcatcgtcattgatgcgggggccagcgtgacgattcaggcaggcgggcagtcgatcacgctgtcggcgggtgggatcttcagcagtgtgccgatccagctcggcggggcgcctgctccagcggttgcaccgctgatgccaggcgcgaaggaaacgttgctggcggtgatacctgccccgttaagccgcgtgcaagtggccagcctgacgcgcagcgcgccgttttgtgaagagtgtgaacgctgcaagaacgggcagtgtgatgtcagcgcccatgcacggagtttgccctgatgacttcgcccttgacgcccagcgcgtggctggcgcactaccccttgcagcccaatgaacaggtgtatgccgtgctcggcagtgccagcgacgccaggccgttcgctgcctggcacgccatggcagctggaaagccaccacaaacgatctgggccggcacggcctatggcgattggagtgaggtgatgccttacgtggctatcgtcgagccaggcagcgccttcctcgattgggtcgctaccacccgggcagtggattggggttggctggcagtatcgccctggccgctggaaaccgtgatcgagcatttgaagggcgtgacccaggtgtacctacctgaaaaccagtcagtatttttgcgcttctgggatggggcgcagtttttaccgatgttgcagcacttgggtgacgaggcggggcgtgtgttaccggtgttccagcgctatctgatcaacggtcagccgttgtcagtgacgccgcgcccgatcacgccggccaagccctgcccttggtggcgagtgccgccgccattgctggcatacctggcgcagcagtcaccgctggtattgatcgacaacctgctgcaatggctccaagagcagcgccccgacctgtacaccgcgtttacgccagccactttgcagcacaaggtcgcctacttcgtgcgcaggccggatatcagccaggcagcactggctgactacctggccgcgcagttgagttgagcctacggcgatagcgcgactcggtaccgcccgccatgcggccctgcacctttacgccggtaaaaggtaaactccggcccctgcgcaggagcaaccatgaactatcgtcacgcctttcacgccggcaaccacgccgatgtcttcaaacacctgaccttgacccgcctcatcgccctgatgtcgcgcaaggagcagccgttcgcctacctcgacacccacgctggcattggcctgtacgacctgcagggcgaccaggccaaccgcacgggtgaatacctggagggcatcgcccgcctgtggggagcaagcgacctgccgccgctcaccgctgactacatgcgcgtgctgcacgagatgaacccggatggccagttgcgctattacccgggctcgccggagctggcccgacgcctgacgcggccacaggaccgcgtgctgcttaacgaaaagcacccggaagacggcgtgctgctcaaggacaacatgaagggtgatcgccgcgtcaaagtgcacctgggcgaaggctggcacgtgccacgcgccatgctgccagtgccggaaaagcgcgcgctgatgctgatcgacccgccgtttgaacagcttgatgaaatgcagcgttgcgcggcgtccctcaaggaagcggtcagccgtatgcgccagacggtcgcggcgatctggtacccggtgaaggaccagcgcatgttgcgccgcttctaccaggacctggccggcaccggtgcgccgaagttgctgcgggtggagttgctggtgcatcccctggacacccccaacaccctgaccggctcgggcctggcgattgccaacccgccgtggggtttggaagaggagttgcgtgagctgctgccgtggctgtccaagaagcttggccagacccagggtgggtggcagatggattggctcatcgccgaataactgttcccaaaccaaacacagaaccaaatgtgggagggggcttgctcccgatagcggagtgtcagttacagctgtaatggctggcactcagcaatcgggagcaagccccctcccacattttcgatttatggtgaccttagatcgggcagatcacgccagtgccgccgattccgcagtaaccctgcgggttcttcgccaggtactgctggtggtacgcttcggcaaagtacaccgtcggtgcttcgtcgatttcagtggtaatagtacccacgccggctttggtcaattcggcttgataagcctcggcgctcgctttcgccgccgccaattgctctggcgtggtggcataaatcaccgaacggtactggctgccgatgtcattgccctggcgcatgccctgggtcgggttatgcagttcccagaacatcttcaacaggtcttcatacttgaccttggcctggtcatacaccaccagcaccacttcgctgtggccggtcaggccagagcagacttcttcgtaggtcgggttcggcgtgaagccgccggcatagccgaccactgtgctgaccacgccgtcgcgttcccagaatttacgttccgcaccccagaaacaccccaggccgaagattgcaaagccgacgtcatcaatgaacgggcccagcagcgggttgccgttgacgaagtgggtctctggcagcgccattggggtttcacggccaggcaaagcttgttcttgagtaggcagcacgtttttgttcaccagaatttccgagcgcaagaccatgatcagtcctctcgtcaggttgagtagcagtaaattgtcagacagccagtgtgcccgagtgttacagcgctgtcaggcgattggcccgcggggatagcgtttaagcttctccagcagctctgcaccggggatcggccggtcgaacaggtagccctggcccacatcgcagcgatgccggcgcaggaacgccaattgctcggcagtctcgatgccttcggccaccaccttgagcttgaggttgtgggccatggcgatcaccgccgaggtgatctccatgtcgtcctggttatccgggatttcgtggataaagctgcgatcaatcttaatgatgtcgatggggaattttttcaagtagctcagcgacgagtacccggtgccaaagtcatccatggccagggtcaggccgaagttcttgagctggtcaagttgcaagcgcgtgtcttcggtggcctccagcagcaagccttcggtcagctccagctccagcaggttggccggcagttgttcttccttgaggatcgtggcgatcgaggccaccaggtccgggtcggaaaactgcttgggcgacagattgatcgccacctgcagattgcccatgcctgcagcgctcaactgtcggctcatgcgacaggcctggcgggcgatccatttgccgatggggatgatcaacccggtctcttcggccacgctgatgaactggtcggggcggatcatgcccttttccgggtggttccagcgcagcagcgcctccatgcccagcaggcgaccgctgcgcaggcacagcttgggctggtagaacacgtccagctcgttctgggtcagggcgcggcgcaggttgttttccacgaacagcttgtagctggcctcggcgttcaaggcttcggtaaatacctgcacctggtgcttgccgttggccttggccttgtgcagggccagcccggcgttgcgcatcagggtctgcgggtcgcggccatgcagcggcgcgcaggccaggcctacggaaccggtgacgctgatcagctggttgtcgacgaacatcggcttgtcgagggtggccagcaactggcaggccacctgttggccagtctccaggtcggcgtcgtccagcagtacggcaaattcgttactggcaaagcgtgccaggctgccgccgctgctcaagctgttgcgcagacggcgggccaggctgatcagcaacttgtcgccggtctggtggccgaggctgtcgttgatgcgcttgaagttgtcgatatccaccagcagcaggctgatcgggctgtcgctgtcgcgggcgaagcgctcatcgaggttgcggataaacgccgggcggttgcccaggttggtcaggttgtcggtgtaggccaagcgttcgatgcgctgttgcgccagcttggtctgggtgatgtcttcgtagatgccgatgtagtgggtcagctcgcggttgtcgccgtacaccttggaaatcgacagttggccccagtagggttccaggttcttgcgccggctcttgaactcaccctgccagctgttgcttttggccaaggccgacggcgcgtcgaacagcaattcgctgagattttccagggccggtagttgggccaggcgatggccgtggacttcttcggcgctgtactgggtgatcgcggtgaagctggggttgacgtactccaccacgccgtcgcagttgaccagcagaaaggcgttggcgctttgttccactgcacgctggaacaggtgcagggcgctggtggcagtgcggcggttgtgattgttgatcacctgggcgaactggtccgccaactcgccggcaaacgcgatctcatcggactgccacgcccgcgagctgccgctttgttccaggcacagcacgccgactacctggccgtcgacccgaatgctggcgtcgagcatcgcgtgaatatctttggcgcgcaggctttcggccatttcccgggtgcgcgggtcgcgcagggcatgagtggcgtcgatggcacggctagagtgcagggcttccaggtaatccgggaaaccactggcgtcgatggtgtcgggcaggcggtgctgctggtcggcacggtggtacgccgagatcggcaccaggcgctgaccttccaggttccagatgctggcgcaatcgatctggtagatgtcgcaggcgctgcgggtaatcagctcggcggcttcttgcagcgaattgggcgtggtgtagcgctggcgggccagcagcaggatcaactcctgctgggcgcgtacccgctccaggtgttgcagctgttcttgctgggcacgctggttgagttccagggcgatctgcaggcggctgttctggttttccaggtcggcggtcggggcgggcgcggtggtatcaccgaacagcccgtcgaccaccatcaggtagccgcgcagcagatggcggttgtgttgtttgtaggcctcgcccatttccagcaggctcatcgggccgtcatgggtgtgcagggtgtagcgcaccaggtaatgggggctgtgggtcagttgctgctggatcgcgtcgtgcagctgatagcgggcctggggctccatcaggctggcgtagggcgtgccgatcagggcacagagttccactgcgggcaggccaaactggcgctcgcaattgggatcgaggtacagcagggcccagcttgcctcattaagccgctcgaaacgcagcataccgaggcgcgaaggcaccggtaattgcgtcactacctcggccgccatacgggcgacatcgggttggcttttcatggggaaactcgcttgggaaaatgcgcgtggcgcccggctcacgccctctttactgtcgcctgcggcaaggttgcatcatgcggcacgcactgacaagagaggatgaaggctaagtgctataaggcagttatcggccgcgcgaaggatttctgcaatcgaagtgacagaaggtgtacaaacctgtcctgtgcatacaccgagcgcgcaaaaaaagccccgccaagcggcggggttgaggtacgagcgtggcgctcggaaatcggtgcggcaggggccttcccggtgaaaggaaggccctgcggcttacagcaggatggtgcggatgtcgttcagcaactggctcaggcgctgggtgaagcgcgccgccgcggcgccgttgatcacacggtgatcgtaggacagcgacagtggcagcatcagcttcggctggaacgctttgccgtcccacacaggctggatggtggccttggaaacacccaggatcgccacttccggcgcgttgacgattggcgtgaagccagtgccgccaatgtgaccgaggctggagatggtgaagcaggcgccctgcatgtcgtccggggtgagcttcttgtcgcgggcctttgcagccagtgcagcggcttcggcagcgagttgcagcaggctcttctggtcaacgttcttgatgaccggcaccagcaggccatccggggtgtcgaccgcgaaaccgatgtgcacgtatttcttgcggatgatcgccttgccacttggcgccagcgaggcgttgaagtccggcagttccttgagcagatgcgcgcacgccttgagcagcagtggcagcacggtcagcttcacgccggccttttcggccacggctttctgcgcaacgcggaaagcttccaggtcggtgatgtcggcctggtcgaactgggtcacgtgcgggatgttcagccagctcgcgtgcaggccggccgcgccgatttgcatcaggcgggtcatcggcacttcttcgatttcgccgaagcggctgaagtccacggtacggatcggcggaatgcccgaaccaccggtagcgccaccggcagccggcgcttccttggctttttgcatcatggccttgacgtagacctgcacgtcttctttcagcacgcgaccgtgaggacccgtggccgacacagcattgagctcaacgccgaactcacgggccagttgacgcacggcagggccggcatgcaccttggcaccgcttggcgcaggtgcggcagcagcagcaggggcgggtgtggcctcggctttcgcagcaggtgctggggcagcagcggccggagcggcttcagccttggcagccggagcagccgctggtgctggagcggctgccggggcagcaccttgtactttcagcttgaggatgaagtcgccagtgccgacttcgtcttccaacttgaccgcgatgctttccaccacgccggcagccggcgaagggatctccatggaggccttgtcggactccagggtgatcagcgactggtcggcttcgacggtatcgccgaccttgaccagcaactcgatgatcttggccttgcccgacgaaccgatgtccgggacgtggatatcttgaacggtggcggcggcaggttcagcagccgcagcggcagccgcagcggcaggcgcttcggctggcttttcagcgggtgctggcgcagcagcggcagcaggagccgccgccgcaggggctgcatcagcagcgccttcgatttccagctccagcagttcgtcaccttctttcaggcggtcgcccagcttcactttcaggctcttgaccacgccggccttgggagcagggatttccatgctcgccttgtccgattccagggtcaggatgctctggtcggcttcgacagtgtcgccgaccttcacaaacagctcgattacttcaccttcaccgctgccgatgtcaggtacgcgaatgagttcgctcacaaaaaatctcctcagcagtccagtgggttgcgtttttccgggttgatcccgaacttgacgatggcgtcagccaccaccttgggttcgatctcaccacggtcagccaaggcttccagggctgccaacaccacaaagtgacggtcgacttcgaagaagtgacgcagcttcttgcggctgtcactgcggccgaaaccatcggtgcccaggactttgaattccttggacgggacccactggcgaatttgttcagcaaacagtttcatgtagtcggtggaggcgataaccggacccttacggccggccaggcactcttcgacgtagctcagcgcaggcttctggccagggtgcaggcggttgctgcgctctacggccaggccgtcgcgacgcagttcgttgaagctggtcacgctccacacgtcggcgccgacgttgaactcgtcacgcaggatcttggccgcttcacgcacttcgcgcaggatggtgccggagcccatcagttgcacgtggtgcgccgcttccttggtgtcttcttcgagcaggtacatgcccttgatgatgccttcttccacgccggccggcatggcaggctgctggtaggactcgttcatcacggtgatgtagtagaaaacgtcctgctgctcttcggtcatcttcttcatgccgtcctggatgatcaccgccagctcgtagccgtaggttggatcaaaggtgcggcagttcgggatggtggcagccaggatgtggctgtgaccgtcttcgtgttgcaggccttcgccgttcagcgtggtgcggccggcggtgccgccgatcaggaaaccacgggtacggctgtcgcctgctgcccaagccaggtcgccgatacgctggaagccgaacatcgagtagaagatgtagaacggcagcatcggctggttgtggctggagtacgaagtaccggcagcgatgaaggagctcatggcgcccgcttcgttgatgccttcttcgaggatctggcccttcttgtcttccttgtagaacatcacctggtctttatcgactggctcgtagagctggccgacggaagagtagatgcccaactggcggaacatgccttccataccgaaggtacgggcttcgtccgggatgatcggcacgatgcgcgggccgatttccttgtccttgaccagttgcgcaaggatgcgcacgaaggccatggtggtggagatctcacgatcgcccgagccgtcaaggatggccttgagggtgctcaggtccggtgtcggtacgctgaagctgttggcgcggcgctgtggcacgaaaccgcccagtgcactgcgacgctcgctcaggtagcgggcttcggcgctgtttggctcaggcttgaagaacggcaggttctccagctcttcgtccttgaccgggatgtcgaagcggtcgcggaacaacttcaagctgtcgacatcgactttcttggtgttgtgcgcggtgttcttcgcctcgccggcaccggtgccataacccttgatggtcttggccaggatgacggtgggttgttctttgtggttgaccgcctggtgatacgccgcatagaccttgtacgggtcgtggccgccacggttgagcttccagatctcgtcgtcggacaggtcggcaaccatcgccttgagttcaggcgtgttgaagaagtgctcgcgaacgaacgcgccgtctttagccttgtagttctggtactcgccgtcgatgacttcgtccatgcgacgttgcaggataccgtcgacgtccttggccagcagtgggtcccagaaacggccccagatgactttggtcacgttccagtgggcgccacggaacacgccttcgagttcctggatgatcttgccgttgccgcgaaccgggccgtcgaggcgctgcaggttgcagttgatgacgaagatcaggttgtcgagcttctcgcggccggccagggagatggcccctagggattccggctcgtcgcactcgccgtcgcccaggaagcaccagactttctgcttgccttccgggatgaacccacgggcttccaggtacttcatgaagcgtgcctggtagatcgcctggatcgggcccaggcccatggaaacggttgggaactgccagaaatcaggcatcagccaagggtgcgggtaggacgacaggccctgaccgtcgacttcctggcggaagttgttcatttgttcttcgctgatgcgaccttccatgaacgcacgggcgtagacgcctggcgaggtgtggccctggaagtagatcaggtcgccgccgtgttcgtcggtcggggcctggaagaagtagttaaagccgatgtcatacagggttgcgctggaagcgaagctggagatgtgaccgcccaggtcagaatctttcaagttcgtgcgcattaccatcgccatggcgttccaacgtaccagcgagcgaatgcggcgttccatgaacaggtcgccaggcatgcgtgcttcgtgggtaacggggatggtgttgcggtatggcgtggtgatggcgtagggcagttgcgagccgctgcgggtcgcgagttcgcccatacgggtcatcaggtagtgagcacggtcttcgccttctttgtcgagaaccgattccagggcgtccagccattcctgggtttcgacgggatcgaggtcttgcatggcttgctccagggcggaaaggctaccagaatcggttgcctgaagtttgcgactggccttgtgggcagacgacataaattcttggatggccgaaggttgcttcggcgtcctgtagttttactacaaatcgtcggccatttcagcctttcgaatgtatatacgagtagtaaaactacacaagactgagcgtatggctcggtctggctggtgagcataatcgttattgttgatcttttgcgaacaagaaaaggtgaaagtttaatgctgtctgccaagattgatttaatttcagctatttataacctttgttcgacagtccatcaccgagggtggttcttgcgttcacagccgcaggtcatttacgcgccgatcaaggatagaccatgagccttcccacgctggccgaactaccggccattctcctgccttacgccagccgggccgagcagtcatttcgtgacgcagtggccgcgctggatgacgatcatggcctttctgcgtggacgccgcaacggtgggccgacttcgcccgcgtgtgcgcagccagtgattttgtcattgaacagagtgttcgtgaccctttgatgttgctcgaactggtggcctggggcgagctggaccgcggctttgcgcccggtgagctgtgcagccagattgctggcgcagtgcaacaagccgaaacagaagatgaactgggccgtgtgctgcgccgccagcgcacgcgccagcaagtacgcatcatctggcgcgacctgactcgccaggctgacctggtgcaaacctgtcgcgatctctctgacatggccgatgccagcatcgaccaggcctaccaatggttgtaccagcgccactgcgcccagttcggcacgcccaccgggcgacgcagcggtgaagcccagcacatggttatcctcggcatgggcaagctcggtgcggtggaattgaacctgtcgtcggatatcgacctgatttttgcctaccctgaaggtggcgaaacggtgggtgtgaaacgctccctggataatcaggagtttttcatccgccttggtcagaaattgatcaaggccctcgacccgatgaccgtcgacggctttgtctttcgcgtggacatgcgcttgcgtccctacggctcgtccggcgccttggtgctcagcttcaacgcgctggagcagtactatcaggatcagggccgggactgggaacgctacgcgatgatcaaggcgcgggtggtggccggcgatcaggtggcgggcgcgcagttgctggatatgctgcggccgttcgtctaccgccgctacctggatttctccgccatcgaagcgctgcgcaccatgaagcagttgattcagcaggaagtgcggcgcaagggcatggccgacaatatcaagctgggtgcgggcggcatccgcgaggtggaatttatcgcccaggcgttccagttgatccacggtggtcgcgacctcagcctgcaacagcgtccgttgctgaacgtgctgggcaccctggaaggccagggttacctgccgccggcggtggtcaccgagttgcgcaatggctacgaattcctgcgctacaccgaacacgcgatccaggcgatcgccgatcgccagacgcaaatgctccctgatagccccgaagaccaggcgcgtatcgcctttatgctgggtttcagcgattgggccgcgttccacgaacgcctgatgtactggcgtggtcgtgtggactggcacttccgccaagtgattgccgacccggatgaagaggaaggcgaagaaagcgagctggtcgtcggtggcgaatggttgccgctgtgggaagagtcccaggatgaagacgccgcttgccgccaactggccgaaggtggtttcaccgatgcgcccaaggccctcaaggccctggccggcctgcgcggtagcccgcaattgcgtgccatgcagcgcctggggcgtgaacgcttggacgcgtttatcccgcgcctgctggcccaggccgtcgagcacgccaaccctgacctggtgctggagcgtgtgttgccgctggtggaagcggtcgcccggcgttcggcttatctggtgttgctcacggaaaaccccgacgccctgcgtcgcctgctgaccctgtgcgccgccagcccgtggatcgccgagcagatcacccgtttcccattgttgctggatgagttgctcaacgaaggccgtctgttcaagccgccgctggcgccggaactggccgccgagctgcgcgaacgccttacgcgcattcccgaagatgaccttgagcagcagatggaagccctacgacatttcaagctggcgcaccgcttgcgggtagccgcctcggaaatcgccggcagcctgccgttgatgaaagtcagcgactacctcacctggctggccgaggcgattcttgaacaagtgctggccctggcctggcgccagactgtcgcccgccacggcgcgccgcagcgcctggacggtaccctgtgcgatcctgggttcatcattgtcggttatgggaaagtcggcggcatcgaactggggcatggttcggacctggacctggtgtttatccacgatggcgacccccaggccgagaccgatggcgccaagccgattgacggcgcgcagttctttacgcgcctgggccagcggatcattcacctgctgaccacccagaccaactcgggccagctctatgaagtggacatgcgcctgcggccttccggtgcatccggcctgctggtgagttctctgggcgcattcgaccgctatcaacaaaatgaagcctggacctgggaacatcaggccctgatacgcgcgcgggtgctggtcggcagccaggatgtgggccaggcattcgagcaggtacgcgctaaagtgttgggacgtgaacgggacttggccaagctgcgccaggaggtcagtgagatgcgtgccaagatgcgcgataacctcggtacccgggccacggcggccggccggggcgccaatgccttcgaggctgcggcggtgttcgatctcaagcaggacgccggaggtatcgtcgatattgaatttatggtgcaatacgcggctttggcgtggtctgcgcaccatccatcgttgctgcgctacaccgataatattcgcattctggagggcctggagcaggttgggctgatgcccgccgccgatgcccatttgttacgtgaggtgtataaggcctaccggtccgccgcgcaccgccaggccttgcagaatgaggccggcacggtcgccggggatcaatttgcagacgagcggcgccaggtgatgcgaatctggcaggcgttgggcttgagctgaaacactattagggcggggaggcataagcctccccgcatcgtttgtggaaactacatgaatattctgatcgttgggcccagttgggtcggtgacatggtgatggcacagacactgttccagtgcctgcggcagcgctatccagactgccagatcgacgtgctcgcccctgagtggagccggccgatcctggagcgcatgcccgaggtgcgcaaggccttgagctttccgctcggccacggcgccctggaactggcgacccgtcggcgcatcggcaagtccatggccggccagtacgaccaggcgatcctgttgcccaactcgctcaagtcggcgctggtgccgtatttcgccggcatccccaagcgcaccggctggcgcggcgagtttcgctatgtgctgctcaatgacgtgcgcaccctggataaagcccgctacccgctgatgattgagcgtttcatggctctggcgtatgagccgggcgccgagttgcccaagccgtatccgcgccccagcctgcagatcgaccccgtcacccgcgatgcggcgctggccaagttcggcctcacccttgatcggccggtattggccttgtgcccaggcgccgagtttggcgagtccaagcgctggccgtcggagcattacgccaaggttgccgagaccaagatccgcgaaggctggcaggtgtggctgtttggttcgaagaacgatcattcggtcggtgaagatattcgccagcgcctgattccgggcctgcgagaggaagcgacgaacctcagtggcgacacgtccctggccgaggctatcgacctgctgtcctgcgccgactcggtggtgtccaacgactccggcctgatgcatgtggcggcagcgctgaaccgcccgctggtggcggtgtacggctccacctccccagggtttaccccgcccttggccgacaaggtcgaagtggtgcgcctgggcctggattgtagcccgtgctttgaccgtacctgccgtttcggccactacaattgcctgcgccaattattgccgcagccggtaaccgatgccttgcaacggttgcagggcgacgtggtcgaggttcgctgagttgcgggtactggtagtcaagacctcatccctgggcgatgtgatccacgccttgccggcattgaccgatgcagcgcgggcgatccccggcattcgctttgattgggtggtggaagaaggctttgccgaaatccctgcctggcacccggcggtggaccaggtgatcccggtagcgatccgccgctggcgcaagaatctctggcaaaccttcaagagcggcgagtggcggcgcttcaagcagcgtgtgcagtcgaccaaatatgacttggtgatcgacgcccagggtctgctgaaaagcgcctggctgacccgttatgtgcgggcacccgtggccgggtttgacaagcactcggcccgcgaaccgatcgcggcacacttctactcgcggcgcctggccgtggcccgtgggcaacatgcggtagagcgcctgcgccagttgttcgcggtggccttgggctacgacctgcccaaaggccttggcgactatggcctgagcaccgagaagctgcttgggctgccgccaaagaaaccttttgtattgctgttgcacggcaccacctgggacaccaagcactggcccgaagcctactggcgcgagctggccgaacgcatgggccgcctgggcgtggacgtgaaactgccctggggcaaccccgccgaaaaggcccgggccgaacgccttgcccagggcctgcccaacgccgaagtgctgcccaagctcaacctggcgggggtggccggtgtattggccagcgcccgggcctgtgtggccgtggacaccgggctcggccacctggccgctgcattggatgtgccgaccatttccctgttcggtcccaccaaccctggcctgaccggtgcctatggcaagggccaggttcatctggccagcgattggccgtgtgcgccatgcctgcaaaaaaactgcacctatcaaccaacggccgacgacctgcgtcggttcgacatccagcgtgagtcgcccctgtgtttcacgcgcttgaatcctgagcgtgtagcaagccggctgagcacgttgttactggctgaggagcagcactgatgcaactggcttttgttttgtacaagtacttccccttcggtggcttgcagcgcgacttcatgcgcatcgctctggagtgccagcggcgcggccaccagattcgtgtgtacaccttgatctgggagggtgatatcccgccgggctttgaggtgctggtggcaccggtcaaggcgctggtcaatcaccgtcgtaacgaaaagctgtatgcctggatccaggctgaccttgccaagcgcccggtggaccgcgtggtgggattcaacaaaatgcccgggctggatgtgtacttcgccgccgacggggtgttcgaggacaaggcgcaaaacctgcgcaaccccatgtaccgctggttcgggcgctacaggcacttcgccgaatacgagcgtgcggtattcgacaaaaacgccaagacccagatcatggtgttgtccgagcatcagcagcagctcttcacccagtattacggcacccaggctgagcgtttccacctgctgccgcctggcatcgcgcgcgaccggcgcgccccgccgaacgccgccgaaatccgcgccgagtttcgcggtgaatttggcctgaccgaggatgacctgttgctggtgcagatcggttcgggcttcaagaccaagggcgtcgaccgcagcctcaaggccttggccgcattgccttcgaagctgaagaaacgcacccggctgtttgtaatcggccaggacgaccccaaggtattccaattgcagagtgcagcattgggacttggcgaccaggtgcagttcttcaagggccgcagtgatattccgcgcttcctgctgggtgccgacttgctgatccaccctgcttataacgaggcggccggcatggtgctggtcgaagcggtggtcgccggcctcccggtactggtgagccgggtgtgtggctacgcgttctacatcgacaaggcccagagcggtcgggtgttggacgagccgttcgagcaagcccagctcaaccagtacctggtggatatgctcgacgatccacacgcacgcgcgacctggagtcgcaatggtctggccttcgccgagacggccgacctctatagcatgccgcagtacgctgcggacctgattctggcggagccaaaccgatgaagttgattcttgccgaacccttcaagaccctctgggccgggcgcgatgcgttcgccgaggtcgagaagctggacggccaggtgttccgcgagctggccgctcgccgtacgttgcgtacggtggtcgaaggccagccttattttgtgaagatccaccgtggcatcggctggggcgaaatcctcaagaacctgattacggccaagttgccggtattgggcgcgggccaggagtggctggcgatccagcgcttgcaggaactcggcgtgccgaccatgaccgccgtggcgtttggcgaaaaaggcagcaacccggccgaccagcattcgtttatcgtcacccgggaactgaccccgattatcagcctggaagacttgaccctcgactgggtcaagcaaccgcccgtgccagccatcaagcatgccttgacccttgagctggcgcgtaccgtcggcgcgatgcaccgcggcggggtcaatcatcgcgattgctacctctgccatttcctgttgcacaccgaccagcccatcagcgtcgacaacctcaagctgtcggtgatcgacctgcaccgcgcccaggtgcgtgcgacgatacccatgcgttggcgtaataaagacctggccggcctgtattactccgccctggaaatcggcttgacccagcgcgacaaactgcgcttcctgaaggcttacttccagcagccactgcgccagatcctggccgagcaaaccgcgctgttggccgaattggagcacatggcggcaaagctctatgcgcgcaagcagcgatacggggatgcgctctgatggcgggttggaacctggaacctgcctacgccgccctggcggatgactttggaagcctggacgcggtcttcgccctgcaaggcgagcggctgacccgcgacccgctgtcggaagtgatccgggtggagcggggtggggtcaattattacgtcaagcgctatgtgggcgccggcaaaggcttacgccgctatttgggccggccgcgggtgaaatccgaatggcagaacctcaagcgtttcgccaaatggggcatccctacggctgacgtagttgcctggggcctggaccgcaagggcctggcctacaaccgcggcgccatgatcacccgtgaattgcccaggaccgaagacctgtcggtgttggccgagcgtaatgacgaacgcctgaaggacccccgttgggtagatggcatcagccgtcagctcgccgaatacacgcggaccatgcacgaccatcgcttcacccacaacgatttgaagtggcgaaacctgttggtggacgaccagcgcaccctgtacctgatcgactgccccaacggcgatttctggcgcggtttctggctcaagtatcgcatcaccaaggacctggcctgcctggacaaagtcgccaagtatcacttgtcggccacccagcgcctgcgcttctacctgcaatatcgccaacgtgcgcacctgacggcgtcggacaaacaacggattcgccacgtggtgaagtttttcgagggacgcgaatgagtgacttcctggcggccgaagaccgcgctttgcttgagcgcaacggcctcgcgacgttcgacgccctgtgggccaagcaactggacgcggtggacgagcccaataccagccaaggcggctggagcagcgtgtatcgcctggaacttgagggtcagggttactacctcaagcgccagagcaactacctgacccgcaccttgcaccggccgttgggcgagcccagtttcgcccgcgagtttcgtaacatcagcctgtatcgaaagctggggatcccggcgttgcaggcggctttcttcggcgagcgcaaggttgcaggcgaacgccgggcgatgctgcttacccgcgccctggatggttggaacgacctggattcattgctggaacaatggccgcaattgagcgatacccagcagcgcgcaatcctgctggcgtgcggcaagctggcgcggcacctgcacggcgtgggtcaggtgcacggctgtttttaccccaagcatattttcctgcaggccaccgcgcagggttacgccgcgcagttgatcgacctggagaaaacccgcccgctgttgttcggctggcgtgaccgggtcaaggacctggaaccgctgctgcgccgcgcaccgcaatggtctgatgcgcaagtgcgccaactgctggcggcataccttgaacagcccgaggacagtgccttggtatccacttggctccaacgcttgaccgcacgccgcagccacaaggagaaccgctgatgcgtctatccgagctgaaaaatgtcggccgttcccccagcctgccgttgactgtcgacttggcagatgccgcaggcccggggcagttgcaactgctgagcctattgcgggtgttgccggggcagcgctacgtgggcgcggcggtttggcgcggtcgcccggtgttggccaagctgctggtgggcagcaaggcggcgcggcattttcagcgtgagctcaagggtgtgcgcttgttggccgagcaaggcctgaccacgccgttgttgctggccgatggcttgcaggaaggcgagggcggctggctgctgtttgaatttatcgagggcgcccaaagcctggccgacgcctggctcgccgtcgagagcctgccgccgttggcggacgaacaaaccgccgtgctcgccgaagcgctgggcgcgattgcccagatgcacgccaaaggcctatggcaggaagacctgcacctggacaatctgctgcgccaggacggcaagttgtatttgatcgatggcgcaggcattcgaaccgaagagccaggcaagccgctgtcgcgcaatcgtgtgctggaaaacctcggggtgttttttgcccagttgccgaaaaacctcgaaccctttaccgaagagttgctggtgtattacctgctcggcaatggcgagcatgccttgcccctggaagccctggaaaagcaggtacgcaaagtcagcgcctggcgtttgaaagatttcctcgacaagaccggtcgcgagtgcacgctgttcagcgtggtacgtggcgcctttgccctgcgtgcgatccgacgcgaagaagagccggccatgctgccggtgctggaacaggcggatgcgttgctcgatcagggccacctgtacaagaccggcggcgcggccagcgtgggcaaggtcgaggtggccggtcgaccgctggtgatcaagcgctacaacatcaagggctttgcccactggctcaagcgcttctggcgcccgagccgtgcctggcactcctggcgcgaaggcaaccgcctggcgttcctcggtatcgccacgcccaagccgctggcggtattggagaagcgctttttatggttgcgcagtggtgcctacctgatcacggagttcctgcctgggccggacatcatcgagcgcttcgcgccctatgtcgaaggcggggatgcgcctgaaaacgagctgctggcgctggaccatctgtttgccgagctgattcgcgagcgcatcagccacggcgacttcaaggggcataacctgttttggagtaacggccgctgggcgatgatcgacctggacgcgatgtgtcagcacagctccatcgccagcttcgctgcggcctatgccaaggatcgtgcgcggtttatgcgcaattggccgcacggcagcgcgttgtatcaagtgattgatcagcgtttgcctaaagagacggatgttttggcgggcctggtttaagagcacgcttgaagtccaaatgtgggagggggcttgcccccgatgcggggcgtcagtgaatgtttctgtaactgatccaccgctatcgggagcaagccccctcccacattagaattgatattcagccccagcccccgcgtaccacgatcgccccgccggcgttgctgacataccggcaggtcgagcgtcgggctggcgctgcgcgagccggtgatcgcgctggggtcgagggtcagcgttgcgtcgccggccagggctgtggtgcacaagcccagtgcaagcagggcggcgggatcggacggttcctacacaaaattgcgcccagcagagcctgtggataacggttcggagtgttagctttcagtccctcaactggagaagcaagcatgaagactggaatggcgaggcggtgggcgctggtaggcagcctgttgctgctggccggctgcgggaccgtgacaacggtgttgcgtgacgatggtgtcgcaatccgggagctcaaggcgaaaaaaacctactgccagtccgttccacgtgtctacagcggcgtggcttatgacctgtgcgtactgcatgcaccgcccaattccgcaggtggcctcgcgctggacggtattccctgggcctttatcgatgtgccgatctctgccgtgctggacacccttgccttgccttacaccctctaccgacaaaacgccgacggtagcctcgaactgcggtagcccagcgagcctggcgcgtgccgctaacagcttccccctgcttttaagctataatcccgccctttagctgtttctcgcccaggcgagaggcacacttttttcaggcgcgacccgcctgcatgcagactaaaagaggctagacccctgtggcattgacgattcttggcctgtccggcgcccttagccatgatccttccgcagccctgtatatcgacggcaagctgattgcggccgccgaagaagagcgcttcgtacgcgacaaacatgcaaagaaccgcatgccttacgagtcggcgaagttctgcctggaacaggccggcatcaagccttccgacgttgacgtggtggcgatcccgttcgccccgatcagcctgttcggcgaggcgcgctggcactacgccaagcgttactggtatgccccggaccgtgccctcgacgcgatcctgatgggcaaccgtcgctacaagcgctatcgcaacaagatcgtctggtgcctggagcaattgggtttcgacccgaagaaaatcaagatcgaaccggttgaacaccacctggcccacgcttccagtgcctaccactgctcgggcttccaggaaaaaaccgcgatcctcggcatcgacggcaagggtgaatacgccactaccttcttcggctacggcgaaaacggcaagatccacaagatcaaggaattctacgacccggactccctcggcggcctgtacggcgcgatcaccgagttcctcggtttcgagatgctcgacggtgagttcaaggtcatgggcatggcgccctatggcgacgccagcaagtacgatttctcgcgcctggcctcgtttgaaaacggcgagctggtgatcaacaccgactacgccaacgtcattggcctgcgtcgttataaagagaagggcaagggtttctacttctcgcctaaactgatcgagtggctggggcccaagcgcgaaggcgatatcgccgacgagccgtacatccactacgcggccagcatgcaggcgctgttcgaaaagctggccctgcagatgatcgattactacctgggtgacatcctcaaggacaccggcaagctggccttcgccggtggctgtgcgctgaacgtcaagctcaaccagaagatcatcgcccgtgacgacgtgaaagagctgttcgtacagccagcttccggcgatgccggtacagcagtcggtgcggcggcctacgtttctcacgcccgtggtgtaccggttgagaagatggaacacgtctacctcggcccgtcctacagcaacgaagatgtaattgccgcctgcgccaagcacgcgagcaagccgaactggcgcaagatcgagaacatgccgcagcgcatcgccaggatcatggtcgacggcaatccggtggcctggttccaggggcgcatggagttcggcccgcgtgcactaggtggtcgctcgatcatcggttgcccgagtgccaccggcgtggctgaccgcatcaaccaccagatcaagttccgcgagcgctggaggcccttctgcccgtcgatgctcgacaccgtggccccgcagatgatcaaggtcgatcacccggcgccgttcatgaccttcacttttgaagtcgccgaagagtggaagacccgcgtgccggaagtggtgcatgaagatggcacgtcccgcgcccaggtactcaagcgcgaatacaacccgcgctactacgacatgatgaaagagctggaagtgctgaccggtaatggtgtgtcgctgaacacctcgctcaaccgtcgtggcgaagcaatgatctgctcgccgaccgatgcgctgaacatgttcttcggctccgacctgcagtacctgatcatggaagacatcctcgtggtcaaggacggcgtggacccttatgacgccgtggtttaaatgctgaaccgcttccagggctggcgtgaacgtggctgggcgcctgtcgaggccgaggtttacgcccaggcctggcagcgttatggcggcagcgtggcgactcatccacaggtgatcgaacggatggccgggctggcgcagatcccggtgcgctacctgggttgggagcaaggcggtgaactcaagggggcgatagccacctgggggcgcgacctggccctgtccaaggaggtgctcaagcgcagcggcaagaaaggcctctttgacctgggcaatgccgagatcatcttgccgattgccgccgatgcgcaggtgccgttgcggcatcgtgcgcgctacctgtcggcgctgaacgaggggcgcgtcagcaccctcaagccccaggccgagcaattggccatggcgcgcacgcccgaagaactgtcgaagaagtttcgctacaaccagcggcgtgaattgcgtttgctggaggaagcgggcggcgtagcgcgggcggtcagtgagttttccagcgtggagctggcggcgatttattgcgacctgttccagcgtcgctggggctttcccgcagcaggcgcggcgcgcctggccgaggtgctggagctgctcaaggagttcctgttcggctcagtactgtttctcaatgacgccgcgattgcggtgcagttggtgtatcaggtgcagtcaaatgagtggttcagtgccgagtacgtcaacggtggcgtcgacccggaaacccgcgcattcagccccggcagcgtgctgagtttcctcaatacccaaagcgcgtgggaacaggcgcgggcggcgaacaagtcgctgcgtttttccttcgggcgttccgaccgtgagtataaggagcgctggtgcaacccggtgccggtgttcagcgtatgagtcgcaagcagcaactgctcaagcgccatcggcgcaacaagcgcatcgcgctgttgatcggcttgctggtgttggtggcagccggcgtcctggtggcttggtggttgccgctgctgctggcggtgctgctgtgggcggcccatgaagcctggtttgccgatcacctgttttactcgcccaaagacagctacggctatgcgttcccggcccgcaatgaacagcccggcctgcgcctggaggcggggcggctgctgttggacacgcctctggctggcgatgaaaccctgatcgtggctgtcgaattgaaaagcgcctggcttgggcggttcctcgaccctgcggtggacgtcttgggcctggaggtgccggatcggcaagtcttcgaacgcggcgtcgccggacggcgttacctgaacctgaccggcgccgccgaagccttggcggcgggcaatgtcaggctgcgcgggcgtttctgccggatcaagggccagccgacactctggcgttttcgccaaccggactatcgccagcaacgggtgatggttatcgcgccccacgccgacgatgccgagctggcggcgttcagcctttacagccaggcgcccgaaagctggatcgtgaccctgaccgccggtgaaattgaagccgaacattaccagcaaatggggctgcccaaggctgaagccgctcgcctcaagggccgcctgcgtgcctgggacagcgtcgccgtgccgcgctgggctggcgttcccgagacgcagtgtgtgcaactgggctacttctgcatgcagttgcaggccatgcaggctgcgccggatcaacctatggcgtcccgcgaagccgacttaagcgatacgcggttgtttcgccagttcaacggctttgcgctaccgggggatgtggacggcgcaccgacctggcataacctgattgccgacctgcgggcgcttttgctcaaggcgcggccacaggtaatcgtgttgcccactccattgctcgacccccacgcggaccacatctgcgcccatgcggcgatccttgaagccttgcaaggcctggagtggcagcccgacacattgctcggctacgccaatcacctgcatgataatgaccgttggcccatgggtgattccggggccggggtggcgctgccgccgcgtttcgataccacgatagagatggtgccttgcagctttgcgctcggcttgagccagcagcaggacaaggccatggccttgggcatgatgcatgacctgcagccgcccgcgccgttcaagcgccggatgcgcaggtggttgcagcaactgctggcgggccgcaagccgtcgccctacggcgaaaacgaattcttccgcaaggccgtgcgccgtcacgagttgttgtgggtcctgaagcaggactgaaagcctattgaaggcaggtcggtattcgcctgtcgccttttttaccgggctgcgtgcccgtagccagatcgctgcatggagagttatgaagccgcgtttcaaggttttgcagttacagccggactacaacgtcaagaccaatgatttcgccgacctgggtgagcaaatcgtcaagtccttgccggctgagcgtttcgaggtgacatccggatttctcagcggccgcccgctgcccggccagcccctgagcgtggctgaacactcccattatttcgagctgccggagaagtccctcaagggcattcgcttcggtgccatgtggcagatctacaagtattgccgcgagcagaaattcgatgtggtcatctgtaaccgcttcaagtcggtaaacatgatgctctcgctcaatcgctggctgaaaattccgctgtgcatcggcatctcccacggtttcggcgagtacgcccgtggttaccgtcgacgccagacccagcgctgggtcagtccggcatggcggtttgtcggggtgtcggaggcggtgaaggactacctggtgaacctcaactgcggctttacccgcgacaacaccacctatgtcaccaacgccatcgacattccccaggccgaagccttgcagttgacccgcgaggacgcccgcaaggccctgggcctgccaatggacgcacggatgatcggcgccctgggccgcctggtaccgatcaagggccacacccatctgctgcaggcctttgccaccctcaaggacaagtatcctgaggcgcaggtaggcatcatcggctccggtcgcgccgaagccgacttgcgtgccgacatcgagcgcctgggcctgactggtcgcgcgcacttgctgggctttcgcgaagacggcatgaagtacgtgcgcggcttcgatatctggaccatgccgtcgttgttcgagggcctggggctggcgcttctggaaggcatgagcggccatctgccggtgattgcctccaatggcccggcgatgctgccgctggtgcaaggcgcgggtggcctgtcccatgacccgggtaacgttgagcaactggccgcggccctggatacctacctggcgttgagcgatgaacaattgcgcgccaagggtgaagaagtgttccgctacctgcaggccaatcacacccttgacgagttcaagcacaagtacctgaccctgattgaaaccggtttgcgtgaagtaggtagagcatgaatcagccacaacccctggtctcggtgattatcgcctcctataaccacggccagtacatcgaacagagcatcctcagcgtgttggggcagacttaccccaatatcgaattgctggtggtggatgatggctccaaggatgatagcgtcgaacgtatcctgcgcttgcaggccgagcacggctttgatttccaggtgcaacagaaccaaggcctcagcgccaccctgaatggtgcgatcgcgcgcgccaagggcagcctgatcgcaccgtttggctcggatgacatcatgctgcctgaccgtatagccacccaggtggcgtatatggatggcaagccgaaggtgggaatgtgtgccggcaacatcgagctaatcgatggtgatggcaacctgcatccggagaaaaaacaacgtcgtgacctgccgtttcgcagcctcgacttcgacgatattttcatggaccgcaagccgttcccaccggcgccgaccatgctgattcgtcgggaagtgctggagcaagtcggtggcttcgacccgcagattcccctggaggacctgctgatccagttgaagatcacggcagcgggctacaccatcgacgcccttggcgtggtgatggccaagtatcgccagcacgcgagcaacacgtacaagaaccatcgctacatgatccagaatattctcaagacctatgccaagttcagcgaccatcctgcttatgatgcggttcgctataacttcctgaactctatgttcctcaagaccgccgaccgcgaccgcccactggcgcgggagattctcaagcagatcccgttgaagttctgggggcgcaagacgttgcgcggtttggtgcgtttgtatctggcgccgctcaagaactgaaacggcgcctcaccctgtaggagcgagcttgctcgcgaaaaaacggagaacaccgcgggcaacttgaatgcccgcgtcattgttcacgattttcgcgagcaagctcgctcctacagatgtttaaaggctctggacctgctcgcggattttcgcagtggcggctgggcttgccaccgaggcgtaccctttgaccagttgctcgaagtgcgtttcgaacagccagttacggtcctgcggataacgctgcatatggcgcaggttacgctggcgcagcgcgtagcgcagtgaggacgggtagatgcgcaggtcggccacgtcgatcaggccgaactcaccgtcgtccatcaacagcacgttacccaggtgcagcgagcggaagtacacgccacgctcgtgcagttgcgccatgaaccggccaaaacgctccaccagcgattcgcgcaagctgctgtccaggctttgcaaggcctggcgcagggtgaggccgggcaatggcgtataggtcacggcgctgctggcatcgctcaggcgatagagccccaggatttccggcgtggggatgcccagggggcgcaactgctcgctgttgctggcaaaacgctccgaatacgggttgaagctgccggaggtgtaccagcggcgtgggcggaatatcttcaggaagctgccgtcttccaggcgtagaactttaggtcccaggccatcggcttcaatgacatgggcattgctgcacatctgctcgaaggctgtggtcttcaggttttgcaccggcatacgcaacaggctgcgatggcgctgggcgatgctcaggccggtgataatcgccaggggaatccacagcaggaaccagtgttccttggggcgcgacagaatgccgccgccctcggtcaggccggcgccgatgccgtaggccagcagcgaggatgccaggatgaacagcggctgtgcgcgttccttgaggctcttgtacagggcccaacccagcatgaatatccaggggataaaaccgatgatgccgacgtaatagagcaccccgagggcgaaactatggggttcgcgcagttggtagccatctgagactgtcaggtatagctcagagtcgtagctatgcccgagccagggatgctcggcgataagctgcaaggtcatgctccacagctcgaggcggaacgagctgccacgcccagtgaccagctcggggaagaacagcaggagtgcggcagcccccaggaccatgccagtgataagcagtgcggcgcggcgattgcggctgacaaaactcatccacaggatggccagcgtcagcgctaccaggggcgtgcgtgatccagtcgccagaacggccgcggtcatgatcgccagggccggtacgctgaaccacaacactttgaggcgctgggtcgtcatgcagacgtacagccaatacacgctgaaaaagccgaaaagatgcgagctcagtagcgggttgtcgagggcgccaaggcctccgatcatgcgcatgcctggttgaaagcctttggcgaacgccaccaggttgcccaggctgaccgccagcgcaatgacagcggcgctgaagaagatcggcttgaacaattcattgcgataatgcagcaacagcccgcacccgccaaacagcatgaaagtgttcagcggtcgcttgaacaggtcggtgtcggtgctgtgttccgggctccagagcaggctggtcagcgcccaggcggaaaatgccaggaaggcgatcgccagcggctcgcgcaacagatccttgaattccctggggcgcatgcacaacagaaacaaagtcggtacgctgaacaggatgtagaaaatccggtgcagtacattacgattgccgacaaagaacagtgcactcaggagcagcaataagccaacaggcaaaatccataggaccaggaagtcgaaaacgcgatttgagccatagttaaggcgcttggagtgcatacagtagagccattccagaaagagaaagccaaccatcttaagctagtggccatgtaatgtcgccggtcggatccaaccgggccgcgggttacaccgggtgcaagtacaacagagaagctgtgctaaagtcagcctcctttttcaaaacgccgcgtgatatgaccgactccagtccgagcgcaagcccttcgagcttgaaaatatacttccgtctgctcagttacgttaagccctatatgggcttgttcgccttgagtatcctcggatttctgattttcgcgtcgacccagccgatgctgggttacatcctcaagtactttgtcgacggcctctccaacccggaagccgtgctgttcccgaccgtgccattcctgcgcgacctgcaattgctgcaggctgtaccgctgctgatcatcctgatcgcggcctggcagggcctgggttcgttcctgggcaactatctgctggccaaggtttccctgggcctggtccacgacctgcgggtgcagttgttcaacaacttgctgacgctgcccaaccgttatttcgataaccacaactccgggcatctgatttcccgcatcaccttcaacgtgaccatggtcacgggggcggcgaccgacgccatcaaggtggtaatccgcgaaggcatgacggtgatcttcctgttcgcctccctgctgtacatgaactggcgccttacgctggtgatgatcgcgatcctgccgttgattgccgtgatggtcagcaccgccagcaagaaattccgcaagcagagcaagaagatccaggtggccatgggcgacgtcacccacgtggcctcggagaccatccagggctatcgcgtggtgcgcagcttcggtggtgaagtctatgaagagaagcgcttcctcaaggccagccagagcaacaccaacaagcaattgcgcatgacccgcaccggggcgatctacaccccggcgctgcagttggtgatctactccgccatggctgtgctgatgttcctggtcctgtacctgcgtggcgacgcctctgccggtgacatggtggcctacatcaccctggccggtttgttgcccaagccgatccgccaactgtcggaggtcagctcgaccatccagaaaggtgtggcgggcgccgaaagcattttcgaacaactggacgaagacgttgaggtcgaccacggcaccatcgagcgtgacaaggtcagcggtcgcctggaagtgcgcaatctgaacttcacctaccctggcaccgaacgccatgtgctcaaggacatcagcttcaccgccgagcctgggcagatgatcgccctggtgggacgttcgggcagcggcaaatcaaccctggccagcctgatcccgcgtttctaccaccatgaaagcggcgaaatcctgctcgacggcgtagagatcgaagactacaagctgctcaacctgcgcaagcacattgcccaggtcacccagcacgtgaccctgttcagcgacaccgtcaccaacaacatcgcctacggcgatctggccggtgcacctcgcgccgacgttgaagcggcggcggcggatgccaacgccaaggacttcatcgaccagttacccaagggcttcgatacccaggttggcgagaacggcgtgctgttgtccggcggccagcgccagcgcctggcaattgcccgggccttgctcaagaatgcgccgctgctgattctcgacgaggccacctcggccctcgacaccgagtccgagcggcatatccaggcggcactggacaaggtcatgcaaggccgcacgaccctggtgatcgcacaccgcttgtcgaccatcgagaaggctgacctgatcctggtgatggacgacggccgaattgtcgaacgcggcacccacggcgagttgctggcgcagaacggttattacgctcgcctgcatgccatggggctggatgcgccggtagcggctgacatcacctgatcaacaggcgtcacggctcgaatgtgggaggggcttgtccgaaggtttttttgtaggagcgagcttgctcgcgaaaaacgtcaacgattacgcgtgcttcctgaataaacgcggcgcctgtgagtttttcgcgagcaagctcgctcctacagagggtagccccctctcacatttgcccctgcagtgcgcgcaagcgaccgcaaaccctgtgctaatatcgcgcccctgttcattttgtatgtgggttgctccatgaagttgtccatgccgcgattcaatcaagccgctgtcttggtggtcggcgatgtcatgctcgaccgttactggcatggcggtacctcacggatttcccctgaggcaccggtaccggtagtcaaggtcgagcaaatcgaagaccgcccaggtggcgctgccaacgtcgccctcaatattgccgccctcggcgccccggcctccctggtaggggtgaccggcgacgacgaagctgccgacagcctggccaacagcttgcagggtgccggcgtgcgtgcgctgttccagcgcatcgcccatcagccgactatcgtcaagctgcgggtcatgagccgtcaccagcaattgctgcgtatcgatttcgaagaacccttcgccaccaatgccctggccctcagcgaccaggtcgatgcgtggctcgaaggtgtcaaggtgctggtgttgtccgactacggcaaaggcgccttgcagaatcaccaggtgttgatccaggccgccaaggcccgcaacattccggtgctggccgaccccaagggcaaggacttctcgatttatcgaggcgccagcctgctgacgccaaacctcagcgagttcgagaccatcgtcggcggttgcgtcgatgaacacgagctggtgagcaagggcgccgctctgatggctgaactcgacctgggcgccttgctggtgacccgtggcgagcacggcatgaccctgctgcgacctgaccatccggccatgcacctgccggcgcgggcccgtgaagtgttcgacgttaccggtgccggtgacaccgtgatttccaccctggcggcgtctatcgcggccggtgaagagttgccccacgccgtggccttggccaacctggcggcgggcattgtggtgggcaagctgggtaccgccgccatcagcgcgccggaattgcgtcgtgcgatccaacgctccgaaggctcggagcgcggcgtgctgggcctggagcaattgctgctggcgattgacgatgcccgcgcccacaacgagagcatagtcttcaccaacggctgctttgacatcctgcacgccgggcatgtgacttacttggagcaggcgagtgcccaaggcgatcgcctgatcgtcgcggtcaacgacgatgcgtcggtcagccgcctgaaaggcccgggccgtccgatcaacagtgtcgaccgacgcatggcggtgctggcggggttgggcgcggtggactgggtgatcagcttctccgaagataccccggagaacctgctggcccaggtcaagcccgacgtgctggtcaagggcggtgactataccgtcgataaggtggtcggtgcggatatcgtgagtgcctatggcggcacggtcaaagtgctggggctggttgaaaacagctccaccaccgcaatcgtcgaaaaaatccgcaacaacaacgagtaacctctgtgacgactggggcgagcctgctcgcctctagctcttcttcggcacgatcttgcgcagcatctgccgcgccttgccggtcagacgcttgagtttcgagtccttttccggttctgccaggccctgctgccttagccaatccttccagcgaatccgctcatcgcgcaccagccagccttcctgccgggcgaagctttccgctaggtacaaaccgcgtgtgctggccgggtacagctggtctttctttacggtgtacagctcggcgagcggctcgccgtctttcaatggcatcaggtacaggtccgggcgctggcggtccaggcgcgccaccagttggtcgccttcgaggcgttcatccacatggaacaagctgagggacttggcttccttcggcacttccaggcgcaggtcataaatcaactgcagtgacgccgtcggcaggtgcacgtaggcccgcgggcgctcgatcaattgagtggtggcgcagcgtaccgggcgagcggcgccggacaaggggctcaggcgaaacggcagggcttcgcggtaatgcagggcggcggagtagggcgccggcagccaagtgtcgttgaaacgcccgccgagccagccttccggggtttcgagcaagcattcctcggcaatttcctggatggcggtgtgcagtggcaggttcagttcatgggccgggacgtagccggaaatcaacttgagcaccacgtcgccgcggtcctggcggcgttggcgcaccaatacccagtaatccttgttctgccaatgcagggtcaggcgtaccgaaacgccgaggttcgccagttcgagggcgaagcgctcggcgtccggaacctctaccggcttgcgccgttgcagggtctgggcaaagttgagcggcatgccgacgctctggtagctcaggccctcgggggtggcttcgacgtgcagcggcagtgtcttgaagttactcgggttttttcgaatcagcgttcgcggcatgtcggctccttcttgcgacggggtcggccgcgtcggcggcatcagagttgacggatgacccgggcagcggttgccgcattatgggccaggtgcagcggattaatggtcccgacaatagcactggcgacgcccgtttgcgcaaacaacagcttgaaactggcatcaattggatccattcctggctccaggcacacgtggccgctggccagggcctttttcaccaggatgcctttgccatgggctgctgcataatcgatcacggctttttcggcctgctcattgaggttgtaggtcaccatcgcgcaatcaccctgttccaacgcttttatgccgccttcgacggtcttgccggaaaaaccgaaagcgcgaatcttgccgtcttttttcagctctgccagggtctggtaaacctcgcaatcgttgaggatatgcaagtcgttgccatcggaatgcaccagcaccaggtcgataaaatccgtttcaaggcgtttcaggctgcgttcaatcgacatccgcgtatggtccgcgctgaaatcgtgccgggacacgccattggcaaactcttcgccgaccttgctgacgattacccagtccttgcgttgcccgcgcaataacgggcccaggcgctcttcgctcatgccgtaggccggtgcggtgtcgatcaggttgatgcccagcgagcgggccaggagcagtagcctgcgtgccgcttcgtcgctggggatctgaaagccgctggggtatttcaccccctggtcgcggcccagcttgacggtacccaggcccagtggcgacacccgcaggccggtgttgcccaagggtcgatgaaagtcgtgcagggttagcatgctcatggcaacagttgctcccaggcaggttggccgatagtcggttttggcaggtcgggcagcgcctcgccggcgccagggcggatgccgtcgcgctccagggcgtgcaggacccggtcggcgaagtccggcgccagggccagcttggtcggccaaccaaccagcaggcggccgtcttcggcgaggaaggcgttatcggggcgggtcagcccagattgcagcggttcggcgcgatccacccgcagggttgcccaccgggtttggctcatgtcgatccagggcagcaattgcgccagctctttctgtgcggtggcgatctgttcctctggtgtgcgtgccacgccatcagcctcggcgatatcgccgcccatgtaccacacccagttgccgtcggcagccgggtgggtggtcacggtgatgcgcggcttggtgccgccgcccaggcaatgggcatacaggggtttgaggcccggacctttggcgatgatcatgtgcagcgggcgtttttgcatggccggctggctcagacccagggccgtgagcacatcggcggtaccgccgccggcactcaatacgatgcgctgggcacggatctcgcggccgtcgactttcaaacccaccagggtgccgtcttcgagcaggggctcgatgtgctggccggcaagcaagccgtcacccgccagttgcgccaggcgtccaatcagacttggcacgtcgaccaccaattccgccaggcgatagaccttgcccttgaaacggcggtcttgcagggctgcgggcaactcgtcgcccttgacctgatcgacgcggccgcgcacggccttgctggcgaagaaactggtgaggttgccggcgagggtgcccggtgaccacaggtaatgggcttgggacagtacgcgtacgccggacaggtccagctcaccgtcacccgccagggcttcacgccagcggcgcggcatgtcggcaatggcttcggaggcgccggtgagggcgccgtgcaaggcatatttcgcgccgccgtggatgatgccctgggacttcacgctttgcccgccacccagggtggcgctttccaccactaccgtagaaaacccctggcggcgcaggcgtgcgttgagccagaggccggcaaccccggcgccgacaatcagaacgtcggtggaaataacggatggcatcggcgacctcagtgttcaagacaagaggcgcagtatacaggctgttgagtggtggtcagtgccccacggttttcgagaacagctgaatcaccaccacgcccagcacaatcaggcccatgcccagcatcgccgggacatccagcttctgcccatagatgaacaacgctgcgacgctgaccatcacaatccccagccctgcccagaccgcataggctatgcccactggcacggtgcgcaccaccagggtgagcatccagaacgcgacgccatagcccacaatcatcaacaacaacgggatcggtgtgctcaaacccttgacggctttcatggagacggtcgcaaccacttccgagcaaatggcaatggccaggtaaacgtaggcggcattcatggggaaatcctcggtagtttcaaaatctgtaggagcgagcttgctcgcgaaaacgtcaacgattacgcgggcttcctgaataaacgcggcgcctgtgcgtttttcgcgagcaagctcgctcctacagtggtcggcattctagttgtttgccagatgcggtaaagtcattacctatctggattggagataggttgagccatgagcgtgcagtggaacctggaacagatgcgcctgttcgttagcgtcgctgaacggcgttcgttttcggccgtcgcccgcgatcagcgcaaggcccaatcggcaatcagcaatggtattgcgctgctggaagcggacttgggcgtgagcctgtttgaacgtagcagcggccgtcagccgagtttgaccgaggccggcgccgtattactggaggaagcccgtgaagtgctgcgccaatgtgagcggctcaacggccgggcgctgtccttgacccgcggcgaggaagcctgcctgcggctggcccaggatgaggcgatgttgttccagccggtgctcgacagcctcgaggcgctggcggtgcactacccgctgctggaagtgcagctgtccagcgccgcccagggcgacgtggcgcgcaagctggtggagcgcaaggcagacctggggctgttgttctatcacgatcagatccccgaggccctggagcgacgggtggtaggcagtgtggaaatggtcacggtgtgcggtgtcaatcacccgctggccaaggaaaagtacgtgacgtgccagcatttggctcagtttcggcagttgctgatgtcgacccagactagcgtctaccctggcagcgaggcggccagcccgctggtgtggcgcgccgacagcttctacgtactcgccgaatggctgatgagtggcctgggctgggcctggctgcctcggcatatcgtgcaatacccaacctatcaacaacagatggtcgagttgaccagcgaatggacgccgccggcgctggtggtcgagttggtgtggcgccgcgatgaacatctggggcccgccgcccgcttcctcgccaaacgttttgccgagtgcttacaggcgatcgactgaaaaagccgataaactccgccgccatgaatagaactatctatagctgtctgttttacctggcgctgccgttggtggccttgcgtttgtggttgcgtgcgcgcaaggcgccggcctatgccaagcgtgtgggcgaacggttttcctatggcttgccggcgatgcgtcccggcgggatctgggtgcatgccgtgtcggtgggcgaaagcattgccgccgcgccgatggttcgtggtttgttggagcgttatccacagctgccgatcaccgtcacctgcatgacgcccaccggttccgagcggatccaggcactgttcgccaacgagccgcgcatccagcactgctacttgccttacgacttgccttgcgccgccaagcgatttcttgatcgcgtgcagcccaagctggcggtgattatggaaacggaactgtggcccaaccatattcatgcctgtgcccagcgcggtatcccggtggcgctggccaatgcgcgattgtcggcgcgttcggccaaggggtatgcgcgtttcgccaagctgactgcgccgatgctctcgcaaatgagcctgttcgctgtgcagactgaaaccgaggccgagcgatttcgcagtcttggtgcgcgtcctgaaaccgtggaggttaccggctcgatcaaattcgacctgagcatcgatccgcaattgccggaacgcgccgccgcgttgcgtgaacaatggggcgccagtgaacggcctgtgtggatcgcggccagtacccacgaaggcgaagatgaagtggtgcttgcggcgcatcgccaattgctcgccagctatcccaatgcgttgctgattctggtaccgcgtcaccaggaacgctttagcccggtgtttgagcgttgcgtgcagcagggctatgcaacggtgcgccgctccagtggcgagcgggtcagcgcgcaaacctcgattttgcttggcgacaccatgggcgaattactgttcctctacgccttggccgacagtgcctttgtcggcggtagcctggtgccgacgggggggcacaatccgctggagccggcggctttgggtaagccggtgatcatggggccccatgtattcaacttcctcgacatcaccgcgatgatgcgcgacgccggggcgttgcgcgaggtggatgacgcagaaggtttggccgaagccgtgaggcaactgttcgaactgccgcaggatgcgcacaggatggcgcaggcggggttgaaagtgatgcaggccaaccagggggcgttaaaacgccttttggacggtttggaaagattgatcgcttactgacccaacacccatcaaatgtgggaggaagcaagccccctcccactttggttttgcagtgtgatcaataacccggacgggccttgagctgctcggcggcggctttggccaaatccggtggcaggaagtccttgtccgggttgtagtcggccttgaggtagcgcgccaggtcttgcaagtcccccgggttcagggtgcccgccgcttgtttcaagcgcaggttgtcgaggatgtagtcgtagcggctgttgttgtagttgcgcaccgaggagtacagctggcgctgtgcatccagcacgtcaacgatattgcgcgtgcccacctgatagccgatttccgtggcttccaccgcgctctggttggagatgatcgactggcggcgtgcttgtacctgttctacatcggtgttcacagcacggtgcaggttgcgggtgttttccaccacctggcggcgcaggccctcgcgttgttgctcggtctggtccaggcgtgaataggattcgcgcacttgcgagctggtaagcccaccgctgtagatcgggatgttcaaacgcagcccaattgtgcgttgggagacatcaccgccgtacgggatgggcaactgattcgggttgctgaaacccagggcgtcgttgtcgcctttttcgtattgcgcgacggcatcgagcgtcggcaagtgcccggccttgcgttggcgcagggtttcttcggcggcggtcaccgcgtagttgctggccagcaggttgaggttctggcgaccggccgtttcgacccaggctttggcgtcgttcggtgccggcggcagcacgggcagggtgtggacgatgccctggatagaattgtattggcgattggtcagggtgatcagcgcttggaaggcgtcatctacctggcgctgggcaacgatgcggttggcccgggctgtgtcatagctggcctgggattgcagtacatcggtcttgtccgacaggcccacgtcaaaacgttcgttggactggtcgagctggcgcttgaaggcattttcttcggccttggtcgaggccaggttgtcctgggcgcgcagcacggcgaagtagctctcggcgctttgcaggatcaggttctgctcggtggccgacagttgcagcgaggcttgttcgttgacggcttcggcggcttgcagttggaaccagcgatcggcgcggaacagcggctggctcagtgtggcgcgccaggagtgggcgtcgcggttggccgtggcggccggctgatcgatctgggtgcgcacgttattgctgtcggcaccggccgacaggtttggcagcaagccggcacgagcctggggcactacttctttttgcgcgccatattgggcgcgggcagcggccaggtcggcgttgttgtgcgccgcttcctgatagacgctgaccaggtcggtgttggtggacaagggcgcttcagctgcccagaccattccattggtcgcacaagacacggcaacagccagtgagagtttgcgcagcatgaggcgatccctagtttaaatattacggcgataatttagcgctcaaggctaaggctggccattcctggcgtcaagtcctgggcagtgcccgagtgtagtggccggatcacggcacaacaatcccacgatcacgccattcatcacgctgaatgcaccgctattggcaatttgcccgcgccatggtctagactggccgagttcttgtcggggtgccttgttggaaggctgagatcggtaaataccggatcccgttgaacctgatcaggttaacgcctgcgtagggaacaagatttctcgtcacccggcgagtcctcttgtgcttcgtccgggatgtagttcgaccatcgaacggccctcgagtaccaagcacagcactggtttcagtgcgtccatccgtcacaggttcgctccgacaaaaatccaccgcctggataagttggagagcccgtgatgacgacaaaactaaaaaataccgtgcacctgagtgaatcggccaaggtcgactccggctccgtgcagccgtttacccgctcgcaaaaaatctacgtacagggctcgcgccccgatatccgcgtacccatgcgggaaatcagcctggatgtgactcccactgagtttggtggcgaaatcaacgcccccgtggtggtctacgacacctccggcccctacacagaccccaatgttgtcatcgacgtgcgcaagggcctggctgatgtgcgctcgccctggatcgaggagcggggcgatacggagcgcctttcctgcctgagttccaaatacggccaggaacgcctggataacccggacctggcctacctgcgctttgcccacctgcaaaacccgcgtcgtgccaaggccggcgctaacgtcagccagatgcactacgcgcgcaaaggcatcattacgcctgagatggagtttgtggccatccgcgaaaacatgaagctcgaagaagcccgtgccgccggcctgctcaagcaacaacatgccgggcacagctttggcgcgagcattccaaaaatcatcacgcctgaattcgtgcgcgaagaaatcgcccgcggccgcgcaatcatcccggccaacatcaaccacaccgagctggaaccgatgatcatcggccgtaatttcctggtgaagatcaacggcaacatcggcaacagcgccctgggttcgtccattgaagaagaagtggcgaagatgacctggggcattcgctggggctcggacaacatcatggacttgtctaccggtaagcacatccatgaaacccgtgaatggatcatccgtaactcgccggtgccgatcggtaccgtgccgatctaccaggccctggaaaaagtcgacggcgttgccgaggacctgacctgggagctgttccgcgacaccctgatcgaacaggccgagcaaggtgtggactatttcaccatccatgccggcgtgttgctgcgctatgtgccgctgaccgccaaccgcgttaccggtatcgtcagtcgtggcggcgcgatcatggccaagtggtgcctggcccaccacaaggaaaacttcgcctacacgcatttcgaagaaatctgcgaaatcatgaaggcttatgacgtcagcttctccctgggtgacggcctgcgcccgggctcggtcgccgatgccaacgacgccgctcagttcggcgaactggaaaccctgggcgagctgaccaagatcgcctggaagcacgacgtgcaaaccatgatcgaaggccctggccacgtgccgatgcaactgatcaaggagaacatggacaagcagctggagtgctgcgacgaggcgccgttctacaccctcggcccgctgaccaccgacatagcaccgggctatgaccacatcacctcgggtatcggtgcggccatgatcggctggttcggttgcgccatgctctgctacgtcacgcccaaggagcacctgggtttgccgaacaaggatgacgtgaagaccgggatcatcacctacaagatcgccgcccacgcagcggatctcgccaaaggccatccgggtgcgcagattcgcgataacgccttgagcaaagcgcgcttcgagttccgctgggaagaccagttcaacctgggcctggacccggacaccgcacgggcattccacgacgaaacgctgccgaaagaatcggccaaggtcgcgcatttctgctcgatgtgcgggccgaaattctgttcgatgaaggtgactcacgaagtgcgtgagtatgcggccaaccagcgtattgaggcggtggatgtggatgtggacgtggccaagggcttggctgagcaggctgagcggttcaagcgcgaaggcagccagctctaccaaaaggtctgatccgggatttcagccgcctgtaagggcctcatcggaagcaagcccccacatttgactgtgttcacaaattcaaatgtgggagggggcttgcccctgatagccatctgtcaaataacaaatgcccctcagagatagcacccttgagctttcaacccagtacttattctcccggcaccgcggtgcctgctgacaagcgcgtcttcggcgcccgcgacctgttctccctgtggttctccctcggcatcggcctgatggtcctgcaaaccggcgctttgctggcgccgggtctggggctgtcgggttcgttactggccatttttctcggcaccctggtcggcgtgctgctgctggctgccgttggcgtgatcggcagcgacacggggctgtctgccatggctgcgctcaaacttagcctcggtagccggggcgccagcctgccggcgctgctgaacctgctgcaactgatcggctggggctcgtttgagatcatcgtgatgcgcgacgccgccagcttgctcggcacgcgggcgttcagcgagggtagcctgctggcgaaccccttgctgtggacgctgttttttggtggcctggcgaccttgctggcggtcagcgggccgctggcgtttgtgcggcagatcctgcgcaaatggggcatctggctgttgctcgccgcctgcctgtggctgacctggaacctgttcgccaaggctgacttagctgccctctgggcccaggccggtgacggttcgatgccgtttgcagtggggttcgatattgccatcgccatgccgttgtcctggttgccgctgattgccgattactcgcgcttcggcaagcgcgccaaaagcgtattcggcggcacggcgctggggttcttcatcggtaatttctggctgatgagcctgggcgtggcctacaccctggcgtttgcgccgagcggtgaagtgaatgcgttgctgctggccctggctggcgcgggcctggggattccactgctattgatcctgttggatgaatcggaaaacgcctttgccgatattcactcggcggcggtgtccagcgggatgctggtgcgcttgaaggtcgagcacttggcgttggccattggcgtaatctgcaccttgattgcctgcctggcgcccttggcgcagtaccagaacttcctgttgctgatcggctcagtgttcgcgccgttgttcggcgtagtgctggtggatcacttcatcctgcgtcgccgtgcccctggcgccatcacggcattgcgctggacggcattgctggcctggctgggaggtatcgccacttaccatctgctcgccaacctgtatccgcaggttggcgcaaccctgccggcactgttgctggcagggctgttgcagctgatcctgggtcgggcgttcagtggcgagccggcaccaggtcaggcttgatcacaccgctgaggcgcgcataggggatggtcatttcgatcagccccatggcgtatggggcgatggtggcgacgttgtacttgagtaccacgccgctgctggtcagggccacgttcggggttttctggaacggccagttcttcacgaactctgagtcgcgatccatctgcgagttgatcagccaggtgttgtgggcgaccttcgcggtgttccagaacgcctgttcctggccgggcagcagcatgtcggccaggttcagttccttatgcagcaggcgtgaataattaatgaagccgcgccccggctcgccgtgggcgacgccggtgtccaggtagctggacacttcaatgatcaccagtccgtcatgctgctcgcgtaccttggcctgcaaatacatgctgtggcggttcggcgattcacgcaggaacttgtcacgataggcattcaaggtggccggtacggcagcacccggggtggtgcgggtcatttgcagcaggcgttgctctaccagggtgtcgagctgtggctcggccgggaagtgcagggtatcgatgttcaccagcgggcagtcagggctgccgcagccgggcttgatctgctccgttttgtcgggggtggtgtccagtggcttgagatggccgggttggaacaggctttggcaggcacccagggtcaaggcaatacaggccacggaggcgattcttaaaagcgacatgtgtgtccttcgtaaatcggtggaaagcgaaaaagagtagcgcttggactgccgatgaggccgtcagttcgccactagactgataagggtgagtttgacgtccgccgcctgtcccggcaaccggaaaggggctgcatcaacgggcattggcgcgttaggatggcgcgaattgcacgcagacattgaggaaaaatatgacggacattgccaagtccacgccgaacaggatcgagatcgttcagcgcgacaatgcctaccagggtttctacaagcttgatcgtgtgcaattgcgccacgagaagttcgatggcggcatgagccgggtgatcaaccgcgaagtcttcgtgcgtcatgatgctgtgtgcgtgctgccctacgacccacaacgtgatgaggtggtgttgatcgaacagttccgcatcggcgccatggggcgcgccggcaacccgtggctggtggagatggtcgccggcctgattgacaaggatgaacaaccggaggaagttgcacaccgcgaggccgaggaggaagctgggctgacattctccgcactgtggccgatcaccaagtatttcccgtcgcccggcggcagtaccgaatttgtccacctgtacctgggccgttgcgacagctcgggcgctggcggcgtccatggactggaagaagaagcagaagatatccgcgttaccgcctgggcattcgaagacgccttgcaagcggtgcgcgacggcaagatttccaatgcagccagcatcattgccctgcagtggcttgcgcttaatcgcgcggaagtgagggggttatggcagtaaaggcacgagaacgttaccgagttgacctgatcgggctgcaagccgcctgcgaggccaactatgcgcggctgatgcgcctgctccccgacatgcgccacacccccgaggcgcggcgtatcgcggtgacccatggcgaccagatgctcggcgtgctggccctggaagtcatcctcacctgcccgtacaccacgacgctgcgcgtgcgccaggagcacagcctgccttggctgccggtaccgcaattggaagtgcaggtgtaccacgatgcgcgtatggccgaagtgatcagcgccgagcatgcgcgacgctttcgcagcatctatccttacccgaatgtgttcatgcaccaacccgacgaaaaagcacagctcaatgtgttcctcggggaatggctgagccactgcctggccttgggccatgagtttgaagtcgtgcggtagatgtgaactgcgtctgcttaccctgctttcctctttgtgtcctgccctagcataatcgcgccacctatccattccagtgattgccttgggagagcgccttgtcgagcgtatccaacgtgaaccccgatgccagcgcgttgttggtgcaactgtccgacagccatttgttcgccgaggcggacactgccctgctgggcatgaatacccgtgccagcttgcagcgggtgatcgaactggtgtgcgagcaacagccgcggatcgatctggtgctggccaccggcgacttgtcccaggatggcacgctcgagtcataccagcagtttcgtgacatgacccggccgattggcgccccggcgcgctggatcccgggcaaccacgacgaaccgcaggtcatggccctggcggccgtgcacagtgatttgctcgagccggtggtggatatcggcaattggcgcattaccctgctggactctgccgtacctggttcggtgccgggctacttgcaggaccagcaactgcagctgctcgctcaggccctgagcgaagcgccgagccgccaccacctggtgtgcttgcaccatcatccggtgcccatcggttgtgcgtggatggagcctatcggcctgcgtaatcccgaggcgctgtttgccgtgcttgaccgcttcccgcaagcgcgggcgctgctatgggggcacgtgcaccaggagatcgaccgcgagcgcaacgggctgcggttgctggcgtcgccgtccacctgtatccagttcgcgccgggcagcgaggacttccaggtcagcgagcaagcgccggggtatcgctggctgcgcttgcatgccgacggacggttggaaactggggtggagcggcttcgggacttcgcgtttaccgtcgactacggcagcaacggctattaagacctgcaaacactgatcaaatgtgggagggggcttgctcccacatgggttctgcggtgtctggaagatcgggtgctcacacctcactccgatccctgtaaactgcgcctctttggcccaagcacggagagcccggcatgtccgcttcgatcctgtatatccacggtttcaacagtgctccggcctccaacaaggccagtcagctgattaccgtgatgggcgccctcggtctggccgagcaactgcgtgtgccggctctgcatcaccacccgcgtcaggctattccgcaattggagcaggccattgaccaactgggacggccgctgctggtcggcagctcactcggcggctactatgcaacccatcttgccgaacgccatggcctcaaggcgctgctggtcaacccggcggtcagcccccatcggatgttcgacggctacctgggcacccagaagaacctctacaccgatgagacctgggagttgacccacgatcatgtcgcggcgctggccgaacttgaagtcccggcaccccaggatgccgcgcgttatcaggtgtggttgcagaccggggatgaaaccctggactatcgcctcgcccagcagtattaccgggcctgtgcattgcgcatccaggccggtggcgaccatggttaccaggggttcgccgagcaattgccggcactgttgagctttgccggcattggcgcagatcagtatcaatccttcgatttttcgtcactgtagaaaatcgcaggtcactttttaatcgaacgactcacgacgagaccccatggccactcccagcgctagctcttataacgccgacgccatcgaagtcctctcgggcctcgacccggtgcgcaaacgtcccggtatgtacaccgacaccagtcggccgaaccaccttgcccaggaagtcatcgacaacagcgtcgacgaagccttggccgggcacgcgaagtcggtgcaagtcatcctccatgccgaccactcccttgaagtgtccgacgatggtcgcggcatgccggtggacattcacccggaagagggtgtgtcgggtgtcgagctgatcctcaccaaactgcacgccggcggcaagttctccaacaagaactaccagttctccggtggtttgcacggtgtgggtatttccgtggtcaacgcgctgtcgactcaggtgcgggtcaaggtcaagcgcgacggcaacgagtatcagatgactttcgccgatggctataaagccaccgagctggaagtggttggcaccgttggcaagcgcaacaccggcaccagcgtgtacttcgccccggacccgaaatacttcgactcgccgaaattctccatcagccgcctcaagcatgtgctcaaggccaaggctgtgttgtgcccgggtctattggtcagctttgaagacaagggcaccggcgagaaggtcgagtggcactacgaagacggcctgcgctcgtatctcgaagactctgtcagcgacttcgaacgcctgcccaacgagccgttctgcggcagcctggccggtaataaggaagccgtcgactgggcgttgctgtggttgcccgaaggtggcgacagcgtacaggaaagctacgtcaacctgatccccaccgcccagggcggcacccatgtcaacggtttgcgccagggcttgctggacgccatgcgcgaattctgcgaataccgcagcctgttgccgcgtggtgtgaagctggcgccggaagacgtatgggagcgcatcgcgttcgtgctgtcgatgaagatgcaggagccgcaattttccggccagaccaaggagcgcctgtcgtcccgtgaagcggcagcgtttgtctccggtgtggtcaaggacgctttcagcctgtggctcaacgagcacccggagctgggcctggccctggccgaattggcgatcaacaacgccggtcggcgcttgaaggccagcaaaaaggttgagcgcaagcgcatcacccaaggcccggcattgccgggcaagctggccgattgcgccgggcaggacccgatgcgctccgagctgttcctggtcgaaggtgattccgccggcggttccgccaagcaagcgcgggacaaggagttccaggcgatcctgccgctgcgcggcaagatcctcaacacctgggaagtcgacggcagcgaagtgctggccagtcaggaagtgcataacatcgccgtggccatcggggtcgacccgggtgcggcggacatgagccaactgcgctacggcaagatctgtatcctcgccgacgccgactccgacggcctgcacatcgccaccttgctgtgcgcgttgttcgtgcagcatttccgcccgttggtggatgccggtcacgtctacgtcgccatgccgccgctgtatcgcatcgacctgggcaaggagattttctacgctctggacgaagctgagcgcgatggcatccttgatcgcctggtggccgagaagaaacgcggtaagcctcaggtcacgcgattcaagggcctgggtgagatgaacccgccccaactgcgcgaaaccaccatggacccgaacacccggcgcctggtgcagttgaccctggaagacttcgccggcacgtcggaaatgatggacatgctgctggcgaagaagcgtgcgccggatcgcaaggcctggctggaatccaaaggcaacctggccgaggttctgggctgatgcgcacaggcttcgccctggcaatcctgatgttgagcgggctggcggccacccaggtggttgccgcgcccgtggcggagctcaagctggtgtccgagcaccctgtggacggcatgcgcggcggtaacctttcgggcctggcgttgtgtggcaaggaactgtggacggtttctgatcgggatgacgatcagatctaccggctggatgccggcgcgcctacctggaacgccgaagcggtgcagatcgatgtgccgcccgtgcccgagtccggtctgccttgggggttgcgttcgcgcaccaaggctgcttcgttcattcgcggcggtgacctggattttgaaggcatcagctgtgatgccgtgggtaatcgctacattgtcagcgaagcccatgcggcggtgttgcaggtcccggcgactggcgcgcccgaatggttgaaaattgcccccggcatggtgcgcgaagcccgggccagtggcatgttgctgcacttcaatgccttgttcgaaggcctggcggtaaaccccgaaggcaatcagatctggctggccgccgagcgtgaacgccgtggcttgatctcgatcaagcgtggccagagcgtatgggattgcgacggcgcctgtgtgttgttgagtgaggccggccaggaagtgcagccggcgcagttcaccaacgccaaggcggtatccaaggactttgccgacctggcgctgttcaacggcaagctgtttaccctggagcgcaatgcgttccagatttgccggcgcgatacgctcacggccaaggtcgagctgtgctggtcgtttgccgaccagatgctcacgccgccgcgacgttatgcacaggcttatggactggccgaagccctggtggtggatgccgacggcgcgtggatcggtatcgacaataattttggcccccgcgccgatggtgaaaaacgccccatggtctatcgtttcgccgcccccgacggtggctggagcgcccagccatgagcccgcagttttttcaaatgacccgacgcagcggcagttccgctgcgcgttacccaacaatgatgaggcccgcatgagtgacatcctcgcagacagcttagatggcgtagaacgccggtcgctggctgacttcaccgaaaatgcctacctcaactactccatgtacgtgatcatggaccgtgccttgccgcatatcggcgacggcctgaagcccgtgcagcggcgcatcatctatgccatgagtgagttgggcctggacgccgattccaagcacaagaagtcggcgcgtaccgtcggtgacgtgctcggtaagttccacccccacggcgattcggcgtgctatgaggccatggtgctgatggcccagccgttcagctaccgctacaccctggtggacggccagggcaactggggggcgccggatgatcccaagtccttcgctgccatgcgttataccgaggcgcggttgtcgcgttactccgaagtactgctcagcgaattgggccagggcactgcgaactggggcccgaactttgacggaaccctcgacgaacctttggtattgccggcacgtttgccgaatatcctgctcaatggcaccacgggtatcgcggtcggcatggccaccgacgtaccgccgcacaacctgcgcgaagtcgccactgcctgcgtgcgcttgctggatgagcccaaagctacggtcgagcagctttgcgagcatatccagggcccggattacccgaccgaagcggaaatcatcacgccccgtgccgacctgttgaagatgtacgaaaccggcaagggctcggtgcgcatgcgcgccgtgtaccacatcgaagacggcgacatcattgtcaccgcgctgccgcaccaggtgtccggtgccaaggtgctggagcagatcgccgcattgatgcaggccaagccatcgaaactgccccaagtgaccgacctgcgtgacgagtccgaccatgagaacccgtgccgcatcgtgatcatcccgaccaatagccgggtggatcatgaagtgttgatgcagcatttgtttgccagcaccgacctggagtccagctaccgggtcaacgtcaatatcatcggcctggacggcaagccgcagttgaagaacctgcgcaatctgctggtggagtggctggagttccgcgtacagactgtgcgccgccgcctgcaatttcgcctcgacaaggttgagcgccgtctgcacctgttggacggtttgctgattgcctacctcaacctggatgaagtgatccatatcatccgtaccgccgagcacccgaaggccgagctgatcgcgcgtttcgagctgagcgaaatccaggctgactacatcctcgacacccgcttgcgccagttggcacgcctggaagaaatgaagctgcgcgacgagcaagacgcgctgctcaaggagcaagccaagctgcaggcgctgctgggcagcgaagccaagctcaagaagttggtgcgcagtgagctgatcaaagacgccgaaacctacggcgatgaccgtcgttcgcctatcgttgagcgtgctgaagcgaaggcgctgacagaaaccgagctgttgcctaacgagaaaattaccgtcgttctgtcggaaaagggttgggttcgttccgccaaagggcatgatattgacgccaccggcctttcgtacaaagctggtgatggcttcaagaccgctgcggccgggcgttccaaccagttcgcggtgtttatcgactcgaccgggcgcagttattcggtgccggcccacaccctgccatctgcacgagggcagggcgagccgttgaccgggcgtctcacgccaccaccgggggcaaatttcgagtgcgtgctgctgccggacgatgatgcgctgtacgtcatcgcctccgacgccggttacggtttcgtggtcaagggcgaagacctgcaggccaagaacaaggcgggcaaggcgctgttgagcctgccgaacaacgccaaggtgatcttgccaaggccggtggatgatcgtgagagcaattggctggcctcggtgaccaccgaggggcgtttgctggtgttcaagatcagcgatttgccgcagctgggcaaaggcaagggcaacaagattatcgggattcccggcgaccgggtggccagtcgcgaagagtacgtgaccgacatcgcggtggtcccggaaggctctaccctggtgctccaggctggcaaacgcacgttgtcattgcgccctgacgacctggaacactacaagggcgaacgcgggcggcgtggtaataaactgcctcgcggcttccagcgagtggacgccttgctggtggaaacgccggtttaagctgtactagaggcctcgatctacgatttaacgcgtagatcgacgctttcgcgctggagtcatggcgcatattcacggatgatatggcctttccagcgccggcgtggccgagcgtgtcaggttatttttagtattacattgtggttcgccttgtggcagccacctggatgggatgatgactgctccacgccttcctctatttttgatgctcgctggccttttggggctggcgggttgcagcacgcaccagccagtgtcgctgtaccagctggacagcggaagtccggctcagccagcccagacagcgggcatggcggtattgcttggcccggtagtcgttgccgattacctgcaacgtgaaaccctgctacaacgtcagaacgacggcagcctgcaaggttccaccgatggtcgttgggcgggcagcctgtcgtccgatatcaatcaactgatgttgcgccaggtggccggccaactggacagccagcgcgtagtgctggcaccagggccatccgggtttactccggatgtgcaggtgctgttgacgatcacgcggcttgactccggcaagtcgcaacctgcaatcctggatgcacagtggcgcctgatagaccgtcgtgggcaggtgcgggataaccgcatcgtacatctgcaggaagagcatgccggcaccaccgcctctcaggtccaggcccagggtgtgctgttgcagcacttggcacagcagttgtcggtggcgctcaagccactggccaatcagccgccggtcgctgccgagacacctcgcaaacaggcttcccagcctaagcctgccgccccggaaaagccgaagatgccgatggctaccccgattcgtaccgatctggaagtattcaggttctgacctgcatcgcagacaaacaaaaaggccgctgaataagcgggcctttttgttgggctgttctgtaggagcgagcttgctcgcgaaaagcgtcaacgataacgcgtgttttctgaataagcgcggcgtctgtgagtttttcgcgagcaagctcgctcctacaaaaagccttagcctcagggtttgcgggtctcatgcatgcgcgccaactggcgctcgagcatcgacggatacggctccatcaaccgctccacgcagcttgccccttcagggctggcaatcgggcgaatacgggcgcgttggcggatcagcgtgtcttcactaatcttgcgctccaccagcagcaggttacggctgtgttgggacaacgccagggcgtcctgggcgatttcggtcagcagcaggtcgatctggctcatgccaaacaggtcatcgcctaccgtcaagcccagctgcagttgcagggtgatgccgctgtcggccacttcgatctgcagggcgtggcccagggcgcgcaacagctcgccacagcagattgcattggtcaggtagtcttcgccgctgtcttcactatggaacagcatcagtgtgctgccatcgttcagggtgtgcagttcgctctggtagagcgaggcggcctggtcgaggcagtcgcggtagcgttcgagcagctcggtcaggcgcgcacgcggcaggcgccgcaattgctcctgcgcacccagttgaacggcgagtacggcgctgtgctgcggctcggtgttcctttccaccgcaaccggcttcggcgcagcagctggggctacggccgaggtatcgcgcaggtcggcgaacggatcttcgtcgtccagctcgtcttcttcggcctttatcacatggcgcggcgctggcttcaggccggctaccggcgcgctttcgtcgaagcccgggtcgcgcaggtcgcgtacttcaaactcaggctcgtcgttgtagtcgtcggtgtcgtcgtgctctggctcaggttcgacttccggcactttaggttccggtgcaaagctggcgtgaagctggcgtgcgaggtcgccgatttcgtcctggcgatcagtggccggggtgtgttcgtcgatatcccgcagccagatgcgcagttgcatcagcggcgtggagatatgccgcccgaggcgcaagctcaaggccaaggccagagccagcaggattgcgctcaagatgcccatgctctgcaggctgatggtcatcggttgctggaactgctgcatatcaaggctgatacgcagttggccggccttcacatcctgaaaggtgatattgctctggtacaggccctcggcttcgcccaacaggccgttcttcgggcgctgcccggcctcggccataatccggttgtccacgctgtagatagcggcatgggccaccagcgggttcttggtcaggttattgagcagcacgttgaggctgaggatgtcgttggacaccagcaactcagtcgccgacgtggcggtctgggtcgtcaggctctcgcccagggcatcggcttgctcatgcatggcctgcttgaactgcaaacccatcacgcaggcatagatcaccagggccaaagcgaccaggatcacgttatggctggcgatgcgtaatgcgatcggtacacggcggtggcgcagtgcccggaagatcagcaggaagaagttatcggtttttactggcgtgggccggttcacttgcgctcggctcttggtccgtgaagttgacgcgcagtatagcgacaggcccatggccggcaaagcgttggctgtgcccgatggtcactgaaagtgggtagaatgcggtttttttccagcctgggggtgcgctttgcgcgaaattgtcctgatcaacatcacaggtcttgaccgaccgggtctcaccgcggccattaccggcgtcctggcccagggtggtgtgaacattctcgacatcggccaggcggtgatccacgacaccctgtcgttcggcatcctggtggaaattcccagcaccgagcaggcctcttcggtactcaaggacatcctgtttacggcctataagctggatcaacaggtgcgtttcaccccggtgtccgaagcggactaccagcactgggtgcaaggccagggcaaaaaacgccatatcgtcaccctgttgacgcgcaaggtcacggccgagcagttgcaacgcgtcagctccattactgcgcaatacggtttgaatatcgaccatatcgaccgtctgtcgggtcgtatgccattggacactcctgccgacaagggcaagggctgcatcgagttctccgtgcgcggcgaaccggcggatgcgcaagcgctacgtgccgaattcctcagcgtcgcccaggagctgaatgtcgatatcgccttccaggaggattcgctgttccgtcgcaaccgtcgcctggcggtgttcgacatggattccaccctgatcgaagccgaggtcatcgacgagttggccaaggcggccggtgtgggcgagcaagtgtccgcgattaccgagcgggcgatggcgggtgaactggatttccgggccagcttcaaggagcgtcttgcgttgctcaagggcctggacgtgagtgtgctggactccatcggcgcgtcactgcgcctgaccgagggcgccgaggttctgttcgccgaactcaagcgcctgggctacaagaccgccatcctgtcgggcggcttcacctacttcgccaagcagttgcaggcgaagttgggcattgactatgtatttgccaacgagctggaagtagtggatggcaaggtgaccggcgtggccgtcgagccgattgtcgatgcgcagcgcaaggcggatctgctcaaggaactggcccacaaggaaggcttgcggctggagcagaccattgcggtcggcgatggcgccaacgacctgccgatgctggcgattgccgggctgggtgtggcgttccgtgcaaagccgttggtcaagcaatcggccaagcaggcgatctcgaccttggggctggatggcgtgctgtacctgctgggcttgcgcgaccgcgacggtcagctctaacgacgaaatgcggtcaaaaatgtgggagggggcttgctcccgatggtggtggaacagtctatacatctctgactggaataccgccatcgggagcaagccccctcccacatttgatctttgcagttttcagatcaggctttaggcagtgcgatagcctggcccatctgcactggcgaacctgccaacaacgcttcggtccacttcacctggtccggcccgaacagcacgatggcggtcgagcccagcttgaagcgacccatctccgcacccttttccaggtgaatcggcgcgcgggcagcttcgtcgtagtggaaggttttcagctcacgcttgggcggagtcaccaggccggcccacacagtttcaatcgacgccacgatcatcgcacccaccaacaccaccgccatcgggccgcgttcggtgtcgaacaggcagaccgcccgctcgttgcgcgcaaacagctccggcacgttttcggcggtggtctggttgaccgagaaaatccgcccgggcacgtacaccatctcgcgcaaggtaccggccagtggcatgtgcacccggtggtagtccttcggcgacagataaatagtggcgaagtcgccacccatgaacggtgcagccagcgccgcatcgccaccgagcaattccagcacgctgaagctgtggcccttggcctggaagatgcggccatgctcgatcgggcctacctggctgacggcgccgtcggccgggctgagtaccgcgcctggggtcgggtccagcgggcgggcgtcgcctttcaaggcgcgggtgaagaaggcgttgaaatgctcataggcggtcaggtcttccaccagggcctgggacatgtccacctgatagcgcttggcgaaccaggcggtgaaggcgttcttgaaccagcgcacgcggcactcggcaacgcagccggccaagcgtgagagcaagtggtgcggcagcaagtactggcggaggataaacaactgctttttcataactgtccttaaaccttaaatctcaacgggggtgtcggggtggttgccccattcgccccaggaaccggcataacctttgactcgcggataaccgagcgccttggccaccaggtaggtgaagccagagcggtggtgagtctggcagtgggtgatgatttctttatcgcgggtcagcccgaggtcttcgagtatctgcggcatgtcacggcggatacgcaggttgcgcgccttgtccatgccggcggtccattcgaaattcaccgcgccggggatgtgaccgcccttggccgcgagcactttttcaccggagtattccagcgggccgcgggcgtcccagatgcccaggtcggcggcgccgagacggctttgcaggtattcgcgggtggcggtggggccatcgtgcagcgtgaggctgaccgggccggcgacgggggcgggggctttggtggagagggggagcttttcctcgagccatgccagcaggccgccgtcgaggtagtggtatttctgatggccgatcacgtcgagcatccagataaagcgcccggcccagccgccgccttcgtcgtcatagaccacgtaggtcgcgtccggggtgtggcccagttcgccgaaaagtttttccaggtcggcttggctgggcaacaggccgggtgccgggggctggcccagttgggtgcgcttggggtcaacgaaatgcgcgccggggatatgccctgcggcgtagcgggcgtcactggtgaggtccacgacaatcaggtgttcggcatcaaggcggccaagcagatcgctggattcgatcaccagcggcaagccagagaagtcaggcatgtgaggtctcctgggcacaaatgttggcgattaaagacggcgattgtagcgcaagcatcaggtgctgcggttggtaaagctgtgcaaggccttttcgatgcattgggcggttttgccgaacgcctgcacggtggtttccgagaacgggcccccgccctggtccgcgacgatcagcatcaccacgcggccgttgcaactcaaagagcgcaacagcaagtgctcgccggtgaacaagcgacgcacgaccggcggtagcaaggccgagaactgcgcatggttgtcggggctgagccgcacctgtgcggatttttcgagcaggcgttgcagcaatgtgctgttgaccacatccaggctcaggtgcgcggcgtccttgggcaacccgtcggcctgatgcacgcgtaaggtactcaaggcgcgatcggccatgaacagcaaaacccgctgcataccgctggctaccaaggcgttcttggcgcaggtggtcaagtgcatggcattggcgaagcgatttggctcgacgagcagctcggtgcagtgcttgcgccacacagccagagactcggcggtgggcggcggcgcgggcagcaggccgcgatggaccttctgcacatgccacggccagatcagcgacagcgccgggtgccagaggtcaggcatcaaggtggtgcgggcactggtcaccgcctgctggtgcacctgctgctgcacgtcactcaatggcacctgcaggtacagcgcggtcaggtattgccaacgctcggtgtgcgggcaggtccaggattcctgggccgacatcgccaggccgttggccagcagcacggtgttggccggctggttcagccagcggcgcaggctgggctcggcatcgagcagttgctggtgacgcagggcatcgtcttcgcgggcaatgtgcagcgccttgaccagcaaacgctgctccgctaacaacagcttgtagccctgtgacacccagatcggcaggtgccaggcgtgggtcaaccccaggcaaaggtccagcaagcgcacgccgaacaactcttgctcgacctggcgcgccgactggcctttatggatcacccgcagctcccattcctccaggagcttggggaaggcgacggccatcggccacagcggtgacagaaacagcaggctgccccagtggatgtcctgccacaaccgcgccaagcggctgccgaacaaaccgttggcttgctgggacgcgtgctggctcaccagtagcagttggcgcaatgccacggggatttcccgggctggcactgagggcaggcgcgtcagcagttcttcggcgcgctcgaggccgaggcggttaagcgcgacttcgaggttttccgcgggttcggccaggctgccatgggtttgactgttggcttcgcgcatgacgcttagcaccaaggccggactgtcttgcatcagctcggcaatatctcgcaatgaactgcgactatcgcgaatggccttgcatacgcgttcatggctggcctggggcacgggcagcaacacatcgtccaggcgcttgatccaagcggcgagggtggtgggttttgcattggatacggtcgtttcgtttgccatgattggggcgcgatcatcacttgcgtttaacacgcccggaacgggccgaattggcttttcgccttaacgggctatagtctggcgcagttttgccgataagtagaacaagagttttccgcaacacccaatatgtccatgaacccgacggcgcaagtacccatctcctatggctaaaattatcggcatcattgtcgtcatcgcaagtgtgctcggagggtacgtcctctcccacggtaaaatcgccgcgttgattcaacctttcgaagtgctgattatcggcggtgcggcgtttggcgcattcttgcaggccaaccccggctacatgaccatgcatgtgatcaagaagtcgctgggcatgttcagttcgcgcttctctcacaccttctatctggaagtgctggggctggtgtacgagatcctcaacaagagccgccgtgaaggcatgatggcgatcgaaggcgatatcgaagacgccgccgccagcccgattttcgccaagtacccggcggtgctcaaagacgagcgcatgaccgcgtatatctgtgattacctgcgcatcatgtcctccggcaatatggcgccccacgagctggaaggcctgttcgacatggaattgttcagcctcaaggaagagctggagcatccgtcccacgccgtgaccggcatcgccgacggcatgccgggctttggtattgtcgcggctgtactgggtatcgtggtgaccatggcctcccttggcgagggcgaccaggcggccatcggcatgcacgtcggcgcggcgctggtggggaccttcttcggtattcttgcggcctatggtttctttgggccgcttgccacatccctggcccacgatgccaaggaagaggtcaacctctatgaagcgatcaaggcatgcctggtagcgtccgcgtcgggcatgccgccgtcgttggccgtggagttcgggcgcaaggtgctctacccgaagcatcgcccaagtttctccgagctggaacaagcggttcgcggtcgctaagccatggaaaacaaccagccaatcatcatcaagcgcgtcaagcgcttcgctgcggggcaccatggtggtgcctggaaaatcgccttcgcagacttcgccacggcaatgatggcgttctttctggtgctgtggctgatgtctaccgccacgccggagcagaaaatcgccatcgccggttacttcaaagacccgattggcttttcggaaagcggcacgcccttcgtgatcgacctgggcggctctccgcagttggcgcctgaacgcaccatcaacccggaagtgcagaccgaatcgccccaggaaaaaatccctatcgagcgcgatacggttgaaaccatggccgagcaggtcgagcaggagcgcctggagctgttgctgcaggaattgcagaataaggttgaggaaaatccgcagctgctgaagttcaaggaccagatttccttcgagatcacgcctgaggggctgcgcatccagattaccgacgccgccaaccggccgatgttcgactccggcagcgcgcgcttgaaaccgtactttgaagacatcctgctggccatggccgacaccatcaaggcggtgccgaacaagatcagcatcagcggccataccgatgccaagccttacgcgggccagggcgacttcggcaactgggaactctcggccaaccgcgccaacgccgcccgccgtgcgctggtggccggtagctatccagacccgcaagtggcgcgggtggtaggttttgcttcctcgcagttgtttgatcccaaggacccgttcaatccggtcaaccgccgcatcgatatcgtggtgctgaccaaaaaagcccagcgtgcgattgaaggcgatcaaccaccgccaccggtaccgactcagggtgatggtgcccctggcgaagtgccagccgaccccaacgcactgccgcctgagcaggaaccactgccggcccatgagttgcggcagaagctgaacctgtttgatgatggcgggatgaaggatcctacggtgcctgcgccggcctcctaagctccagatacaacaaggccgcgatgatcgcggccttgttgtatctaccgtttcactgtaggagcgagcttgctcgcgaaaaacgtcaatgataacgcgtgtattcaggatgcccgtgttgctcttggggtcttcgcgagcaagctcgctcctacagaggctggcggtttagtagctgctctcaggcaagctcgcaataatcgaccgatagctgttcatccgctgctgttgcacgcggccatcttccagggccttgagcaatgcacagcccggttcgcggtcgtgtttgcagtcgcggaagcggcaggtgccgatcaggtcgttgaactcgataaagcccgcttccacatcgctgcggctgacgtggcccaagccgaattcacgaatacccggggagtcgatcaattcgccgccgccggggaagtggaacaaccgcgcggtggtggtggtgtgagtgccctggccggacagttccgacagtggccccacgcgggtatcgacttccggcaacaggctgttgaccagcgatgacttgcccacgccagactggccgacaaacacgctgatccgtccgtccagctgctgttgcagctgttccatgccgttgccgtgatgggccgacacttccagcaccgggtagcccagggtgcgatagaccgccagcaacgcattgagcgccggggcgttctgctcgtcgatcaggtcgaatttgttcaacagcaacagcgggcggatgccggcgtgttcggccgcgaccaggtagcggtcgatcaggttggcatggggctcgggcagcggcgcgaacacgatcacgatcatgtcgacgttggcggctaccggcttgagctggccacggctgtcggggcggcgcagttcggtgctgcgtggcaattgggcgacgatcacgccgatgccctggttgccggcacgccacacgactttgtcgccggtgaccagcgcaggcaggttggcgcgcaggtggcaacgggatactgagcctgcgagctcgccttccagcgcctcgacctcgacctgcacaccgaagtgcgcgatcaccaggccggtttgttctgggccgaggtcgccgccctcgagtgcttccacggcggaggattcacgtttggcggcgcgtgcggcgcgttcaccttgaatcttttcgatgcgccagttttggcgacgattgagctggcgtttggccattggtgttccgtgtcgataatgcaaaggttaggtaaaacggtcgcgagtctagcacgcccccgcctgctaaactgcctggctacgccaaggtgccaagagaatcaagccatgcaaaacccacagaacctgatttggatcgatctggaaatgaccggtctgaaccctgacaccgacgtcattatcgagatggcgaccattgtcaccgacagcaacctcaacaccttggccgaaggtccggtgatcgccatccaccatagtgacgccgtgctcgccaccatggacgagtggaacacccgcacccacggtaactccggcctgacccaacgcgtgcgcaacagccgcatcagcatggccgaagccgaggctgaaaccatcgccttcctggaaaagtgggtacccaagggcaagtcgccgatctgcggcaacagcatctgccaggaccgacgcttcctttatacgcatatgaaggcgctggagagctacttccactatcgcaacctcgacgtgtcgacgttaaaagagcttgctgcgcgttgggcgccggaggtcaaggacagcttccataaaggcagcacgcacctggcgctggatgatattcgcgagtcgattgccgagttgcagcattaccgcaagcatttcatcaaggcttgaaaaaggggcgactgctgaacatgtgggagggggctttaatgggttgcaaatccaagtgttggagagcgtttgcccccttttggtgccatcagcaaatgattagactgccggcctctctgcaaggatcgccatcatgctgctgatgctctacctcattgccatcaccgctgaagccatgaccggcgcgctgtccgccggccggcgcggcatggactggtttggcgtggtgctgatcgcctgcgtgacggccttgggcggtggttcggtgcgcgatgtattgcttggtcactacccgctgacgtgggtaaaacacccggaatatctggtgctcacctccgtcgcggcgttggtgacgatctttatcgcaccgctgatgcgccgccttcgctcgctgttcctggcgctggacgccttgggcttggtggcatttaccctgatcggctgcatgaccgccctggaaatgggccacggcatgctagtggcatcggtcagcggggtgatcaccggggtgtttggcggcattctgcgggatatcttctgtaacgacattccgctgatttttcgccgggagctgtacgccagcgtgtcattcctggccgcgtggttctatctactgtgcctgtatctggaactgccgagcgaacaagcaattctgctgacgttattcagcggctttctattgcgcctgctggcgatccgttttcactgggaaatgcccaagttcgtctacaacgacgacgtacactagcgggccgcgtgctggttcagcgcccattccacatgctcgcgcaccaactccgaggggtaatcccgccgcgccttcaaggcttccagcaccggtatgctcgacggcgcattgcccaggcctaccgccaggttgcgcaaccagcgctcatacccggcacggcgcaagggtgagccttcggtgctgctgaggaatttatcctcgtcccacataaacagttcggcaagttccgcgttatccagattgtgccgtggcttgaaatcgctttcggcggtgggtcgtgcgaaacgattccacgggcaaacgatctgacagtcatcgcagccaaatacgcggttgccgattaacgggcgcaggtcctcggggatggcgctcttgagttcgatggtcaggtaggaaatgcagcgccgggcgtccaatacataagggccgacgaaggcattggtggggcagatgtccaggcaggcggtgcagcggccgcagtgttcggtggcttggggtgggtccaccggcagcggcagatccacaaacagttcgctcaagaagaaataactgccggccttgcggttgagtaccagggtgtttttaccgatccaacccagtccggcttgttcggcgatggctttttccaatacgggggcgctgtcgacaaaggcgcgaaaaccgaaggggccgatctgtgcctggatgcgatcggccaactgctgcacgcgcttgcggatcagcttgtggtagtcgcggcccagggcgtagcgcgagatgtaggctttttccggcttggccagctgttgtgccatctgggtatcgccgggcaggtagtccatgcgcagcgacaccacccgcaaggtgccgggcaccagttcgtcggggtgtgaacgtttgctgccgtgggcgcccatgtagtccatctcgccgtggtagcccgcgtcgagccagcgttgcaggtgctgttcatgctcagccaggtcgaggccgctgatgccgacttgttggaaacccagctcgcggccccagtctttgatcgattgggcgagggcgggcagatcggaggtaatagcaggcatgagacacaggaaaccacgggttagatgcgtataattctgccagacatcggagcttgaagacgcatgcctcagacaaaacacccaataaccgacgttcagcccctgttgcccggccatttgccgcaactggctgcgcgttccccggatgcccataaaggccagttcggccatgtattagtcatcggtggcgaccgcggctttggtggcgcggcgttactgagtaccgaaagtgccctgcgcagcggtgccggcatggtgtccctggcgacccgccctgagcatgtgccggcggcgctggcacggctgccggaagtgatgacggtgggcgtcagctctgcgaaccagttgatgagcctgctggaaaaaacctcggtcatcgtgattggccctggcttgggcaccgcggcgtggggcaaaagcctgttgtccgtggcggccaatgcccagcagccgcaggtctgggatgctgacgcgttgaatcagttggccacaggcagcgtcagtcttcctgccaatagcgtgatcaccccgcatccaggtgaagccgcgcggttgttgggcatttcgacagccgaggttcaggcagaccgccttaaggtggcgcgcgcgttgagccatacattcaatgcagtggctatcctcaagggtgctggcagtttgattgccagccctgacgggcgggttgctcgctgtgatcaaggccacccggccatggcgacggcggggctcggtgatgtcctggcgggcctggtcggtgccttgttggcccagggcatgcccgcgtatgacgcaagctgcctggccgtgtggttgcacgccacggcgggggatcgccaaggcagttttggtcgcggtctggcggccagcgacctgatacctgccattcgtcaattgctggaggagcaatcgccgtgcctgaattagtgcttttcctggcgaatgaagacgccatggttgcgttcggtcaacgcatctcgcaggtcaccgccggggcaggattgatttttctcgagggtgaccttggggccggcaagaccacactgtcgcgaggaattattcgcggtctgggccatacgggcgcggtgaaaagcccgacgttcactttggtagagccttacgagatcggcgacgtgcgtgccttccacttcgacctctatcgcctggtagaccccgaagagcttgaattcatgggcatccgtgattatttcgacgaagatgcgctatgcctgatcgaatggccagataaaggcacaggctttttgccaaagccagacatgaccattaccattacgccgcatgagcacggacgtcagctgaagttgttgccccagagcgagcgcgctaaagcttggtgcgccattctggcattggaattcaaataaaattggtggggttaggtatgcgctttcgcgcgttggttgctgtcgtgggggtgttgcttgcggcaatgactgtcaatgctctggctgcttcacaggtaaaaagtgttcgcctgtggcgagcgccggataacacgcgactggtgttcgacctgtctggcccggtccagcacagcgtctttaccctgacggcgcctgatcgcctggtgatcgacatcaacggtgcgagcctggccgcgccgctgaaggtgtctaccgccaacacgccaattaccgccatgcgctcggcccagcgtacgccgaccgacctgcgcgtggtcatcgacctgaaaaaggccgtgacccccaaaagtttttcgctggcacccaacgcccaatacggcaaccgcctggtgttcgacctgttcgacaaccctgccgacgccgcaccgccgcctgcgccgacgccaagcgtggcgacggtaccggcggtgccggtcaacccttcgcaaccccaggtcaagctgccacctccgccgcccgcaccggctggcaagcgcgacatcatcgtggtgatcgacgccggccacggtggcgaagacccgggtgcctccggctcccgcggccagcatgagaaggacgtggtactggcgatcgcccgcgagctgcagcgccagatcaacggcatgaagggctaccgcgccgagctgacgcgcaccggtgactacttcattcctttgcgtggccgtaccgaaatcgcccgtaagaagggtgctgacctgttcgtgtcgatccatgccgacgccgcgccgtccactgccgcctttggtgcttcggtgtttgccctgtcggatcgcggcgccacctccgagaccgcccgctggctggctgacagtgaaaaccgttccgacttgatcggcggggccggcaacgtgtccctcgacgataaggacaagatgctcgccggcgtgctgctcgacctgtcgatgaccgcctcgctgacctccagcctgaacgtcggccagaaagtcctgagcaacatcggtcgcgtcacctcgctgcacaaacagcgcgtggaacaggccgggttcatggtgttgaagtcgccggatatcccgtcgatcctggtggaaaccgggtttatctccaacgccaacgaggcgtcgaaactggccagcgccagccaccagcaggcgttggcacgctcgatcagcgccggcgtgcgccagttcttccagcagaacccgccgccgggcacctatatcgcctggctgcgcgactccggcaagatcgcccagggcccgcgtgaccatcgcgtgcagcccggtgataccgtcgccatgctggcagtacgtttccaagtcacgcctgcggccttgcgcagcgccaataacctgaaaagcgatgaattgaagatcggccaggtgttgaccattcccggcactgaattggcggcgcagtaatgagcgaatccatcttgaacagcggctcgcgcattgaattgctcagcccgcgtcttgccaaccagatcgccgccggtgaggtcgttgagcgcccggcttcggtgatcaaggagttgctggaaaacagcatcgactcgggcgccaagcgcatcgatgtcgacgtggagcagggcggtgtcaagctgctgcgggtgcgcgacgacggcagtggcatctccgccgatgacctgccgctggccctggcccgccacgccaccagcaagatacgcgacctggaagacctggagcgggtcatgagcctgggctttcgcggtgaggccctggcctccatcagttccgtggcccgcctgactctcacttcccgcacacgcagtgccgagcaagcctggcaagtggaaaccgaaggtcgcgacatggcgcctcgggttcagccggcggcgcacccggtgggcacttcggtggaagtacgcgacctgttcttcaacaccccggcacggcgcaaattcctcaaggccgagaaaaccgaattcgaccacctgcaagaagtcatcaagcgcctggccctggcccgcttcgatgtggcgtttcatctacgtcacaacggcaagaccatcctcagcctgcacgaagcccacgacgacgccgcacgcgctcgccgggtggcggcagtgtgcggtagcgggttcctggagcaggcactgccgattgagatcgaacgcaatggcctgaggctgtggggctgggtcgggttgccgacgttttcccgtagccaggccgacttgcagtatttctttgtgaacggccgtgcggtacgcgacaagctggtggcccacgcggtgcgccaggcctaccgcgacgtgctgttcaacgggcggcacccgacgtttgtgctgttctttgaggtcgacccgtcggtggtcgacgtcaacgtgcacccgaccaagcacgaagtgcgcttccgtgatgggcgcatggtgcatgacttcctgtatggcacgctgcaccgcgccttgggcgatgtgcgtccggatgaccaactgtcagcgccgattgtcacggccgtggtacggccaactggcccggaagccggagagttcggcccccagggtgaaatgagcctggccgccaacctgctgcaatcgccacagtcgcaaccgacctacacggcgccgaactcgggtgccggtgcgggctatcagtatcaatacacgccgcgcccgcaatcaacagtgccggtggccgaggcccaggcggcgtaccgtgagtttttcgctccgctgccgggcgccgagccgggtattgctccttcactgccggaaggcggcggtgatattccgccactgggctatgccctggcgcagctcaagggcatctacattcttgcggaaaatgcccatggcctggtgctggtggacatgcacgccgcccacgaacgaatcatgtacgagcgcctgaaagttgccatggccagcgaaggcctcagcggccagccgctgctggtgccggagtccctggcggtgagccagcgcgaggccgattgcgccgaagagcatcacagtgtgttccagaaacttggcttcgaattgcagcgcctgggcccggaaaccctggcgatccgtcagatacccgcattgctcaagcaggccgaggccaaccgcctggtggccgacgtgctggcagacctgatggaatacggcaccagtgaccgtatccaggcgcatatcaatgagctgcttggcaccatggcctgccacggtgccattcgcgccaatcgccgcctggccctgccggaaatgaacggcctgctgcgcgacatggaaaacaccgagcgcagcggccaatgcaaccatggccgaccgacctggacccagatgggactggacgatctggacaaactcttcttgcgcggccgttgatgagcgccttgccccccgcgatcttcctgatgggccccacggccgccggcaagaccgacctggccatcgagctgaccaaggtgttgccctgcgagctgatcagcgttgactctgccctggtttaccgggacatggacattggtactgccaagccgtcgaaagcgttgttggcccagtatccgcaccgtttgatcgacatcatcgacccggccgagagctattcggccgcggattttcgtaccgacgccctggcggccatggctgagatcaccgcgcggggcaatattccgctgctggtgggcggtacgatgctctactacaaggctttgcaggaaggcctggccgatatgccgcctgctgacgcccaagtgcgcgccgaactcgaagaagaggctgcacgcctcggctggcaagccttgcacgatcaattggcggcggtggacccggtgtccgcggcgcgcattcaccccaatgacccccagcgcctcacccgtgccttggaagtctggcgtgtgagtggccggaccatgactgaacacaggctgaaacaaagtgcgcaaagtgctgatgccggcgcatctggacagtcacaattgccctatactgtggcgaacctggccatcgctccggcaaatcgccaggtgctgcatgaacgaattgcacaaagattcacaattatgttggaacaggggtttgtggaggaggtcgtagcactgcgttcaagaggtgacctgcatcccgggctgccttcgatacgtgctgtaggctaccgccaagtctgggatcatctggatggcaagctgacgtcagccgaaatgcaggagcgcggcatcattgccacgcgccaattggcgaagcgccagttcacctggctgcgcagctggagcgatttgcactggttggacagcctggacagcgacaatctgtcacgcgccttgaaatacttgggaacggtctccatattgagctgagtccttgcaattgccgtctatccttgggggtgtggcggccataagctatctattttccgattttttattattgatccttaaaggagtgcggcacatgtcaaaagggcattcgctacaagacccttacttgaatactttacgtaaagagaaagtgggggtttccatctacctggtcaacggtatcaagctgcaaggtacgatcgagtcgttcgaccagttcgtgatcctgctgaaaaacaccgtcagccagatggtctacaagcacgctatctcgacagtcgttccagttcgtccaatccgtctgcctagcgcagcaggtgacgaacagggtgacgctgagccaggtaacgcctgataggagtctcctttgttctttgagcgccacggtggtggtgagcgagtaatcctcgttcacttggatggacaggaccctgaggcgcgcgaagatccgcaggagtttcaggagttggcaaattcggccggcgccgagaccgttgcgttttttaacgtgccgcgtcatcggccaaccgccaaatacctgataggcagcggcaaggtcgaggaattgcgcgacctggtccacgccgaagaagccgatctggtgatcttcaatcacattctcacgcccagtcaggaacgtaacctcgaacgtgttttcgagtgtcgcgtgattgaccgtaccggcctcatcctcgatatttttgcccagcgcgcccgtacccatgaaggcaagctccaggtcgaactggcccagcttgaccacatgagcacccgcctggttcgcggctggactcaccttgagcgccagggtggtggtatcggtatgcgaggcccgggtgaaacccagctggaaaccgaccggcgcctgctgcgggttcgcctgcgccagatcaagggccgcctcgagaaagtgcgcagccaacgcgagcaatcgcgacgtgggcgtacccgcgcggatatcccgaccgtttccctggtgggttataccaacgccggcaaatccacgctgttcaacaacgtgacgaaatcggacgtgtacgcggccgaccaactgttcgcaaccctcgacccgaccctgcgccgcctggatatcgacgacctggggccgattgtcctggccgacaccgtgggtttcattcgtcacctgccgcacaagctggtcgaggcatttcggtctacgctcgaagagtcgagcaattccgacctgctcttgcacgtgatcgatgcggccgaaccggatcgcatgctgcaaattgaacaggtcatggtggtgctgggcgagattggtgcccaggacttgccgatcctcgaggtctataacaaactcgatttgctcgaaggcgttgagccacagatccagcgcgacgaaaacggcaagccccaacgggtctggttgtcggcgcgtgatggcagtggcctggagctgcttgaacaagccattgccgaattgctcggcagcgatttgttcgtcggtaccttgcgcttgcctcagcgttttgctcgactgcgtgcacagtttttcgagttgggcgcggtacagaaagaagaacacgacgaagaaggtgtcagcttgctggccgttcgattgccgcgctcggagctcaatcgactggtcagtcgcgagggtgttgtaccggcagagttcatcgaacaacacactttgcaataaaagcctcctaaagcggttgtgccgcggtagcaggcattctgtagcattggtcggcgcgccgtgggtgcgtctttgctttatcagatggagagcgctatggcttggaatgagccgggtggcaactcgaataatcaggatccttggggtggtaagcgccgcaataatggcgaccgcaaggggccaccggatctcgacgaggccttccgaaagctgcaggaaagcctgaatgggttgttcggtggtggaaaaaaacgtggtggtgacgacggcggtcgcacaagcaagggcggtggctatggcctgttgggcctgggtcttgtcgtgctggcggccgtgtggctctacagtgcggtatacgtcgtggacgagcaggagcaggccgtggtgctgcgcttcggcaagtactacgagactgtcggcccgggcctgaatatctatttcccgccgatcgacaagaagtacatggagaacgtcacgcgtgagcgggcgtacaccaagcagggccagatgctgaccgaagacgagaacatcgtcgaagtgccgctgaccgtgcagtacaagatcagcaacctgcaggacttcgttctgaacgtcgaccagccggaaatcagcctgcaacacgcaaccgaaagtgccctgcgccacgtggtgggttctaccgccatggaccaggtgctcaccgaaggtcgtgaattgatggcaagcgaaatcaaggagcgtctgcaacgcttcctcgacacctatcgcaccggtatcaccgtcacccaggtgaacgtacagagcgcagcggcaccgcgtgaagtgcaggaagcctttgacgacgtgatccgcgcccgtgaagacgagcagcgttcgcgcaaccaggctgaaacctacgccaacggcgtcgtgccggaagcccgcggccaggcccagcgtatcatcgaggatgccaacggctatcgcgatgaggtggtctcccgtgccaagggtgaggcagatcgctttaccaagctggtagccgagtaccgcaaggcgccggaagtcacccgtgagcgtctgtacctggacaccatgcaggaagtcttcagcaacaccagcaaggttctcgtgactggcagcaagggtgggcagaacaacctgctgtacctgccgctggacaagatgatcgaaggtggtcgtagtggcaccagcgcaccgtctaccggttccagtgccgctgccaacgaagcgagcgcccgtgcggccgctgacttgctgcaacagcaaacacgtaccagggagagtcgttgatgagcaataaatcgctgaccgccctgattgtgggcgtcgtcgtggtcatcgctgcctggaactgcttctacatcgtggctcagaccgagcgtgcggtgctgctgcaattcggtcgtgtggtccaggcggatgtccagccgggcctgcatgtgaaagtcccctacgtcaaccaggtgcgcaagttcgacgcccgccttatgaccctggatgcaccgacacagcgcttcctgaccctggaaaagaaagccgtgatggttgacgcctacgccaagtggcgcgtcaaggatgccgagcgcttctacacagcgacctccggcctcaagcagattgctgacgagcgtctgtcgcgtcgtctggaatcgggcctgcgtgaccagtttggtaaacgcaccctgcacgaggtggtatccggtgagcgggatgcgctgatggctgacatcacgcgttcgctgaacaccatggcggaaaaagagctgggtatcgaagtggtcgatgtccgggtcaaggccattgacctgcccaaggaagtcaaccgcagcgtgttcgagcgcatgagcaccgagcgtgagcgcgaggcccgtgagcaccgcgccaagggtaacgagctggcagaggggatccgtgcggatgccgaccgtcagcgccgtgtcctgcttgcagaagcttatcgcgagtctgaagaggcccgtggtgatggtgatgcccaagccgcggcgatctacgccaaggcctacggccaggaccaggagttctacgcgttctaccgtagcctgcgcgcctaccgtgaaagcttcgcgaacaaaaccgacgtcatggtgctggacccaagcagcgacttcttccgctacctggaaaagtccaagtaaccagcctgtaattctgtaggacgcactccgtcgggcggctaaaatgcctggcggggtgctcctttcagaaaacgggtgtatgatgcggcagccgggaaattcccggcttttttgcgtctgcatgtttgattcggcaggcgtgacaggtttttcgaggaaagtgcccgacgaggccggttacaggccgttcgtcacgtcgctcttgcgcgtggtttatgcaagaggcgggtattttctgcttcactcaaggttcggccgagggctggccgcccggatcaaaggggaatggcgtaatggcaacggtagaccgctggctgctgccagatggcatcgaagaagtactgccaccagaagctgcgcgcattgaaatagcgcgtcgccaggtgttggatctgttccagagctggggttacgagtttgtcgtgactccccatatcgagtacctggaatccctgctgaccggcgcgggccaggacctggatctgcgcaccttcaaggtcatcgacccgcaatcgggccggcaaatgggtttccgtgccgacatcacgccgcaagtggcgcgcatcgatgcgcacactctgcgccgcgaaggtcctagccgcctgtgctacgccggcagcgtgctacatgcccagccgcgtgccttgtcgtcttcccggagcccgatccagttgggcgccgagttgtacggcgatgccagcccgagcagcgatgttgaagtgatcagcctgatgctggccatgctgcaactggcggatgtgccggatgtgcacatggatctggggcatgtcggtatctaccgcggcctggcccgtgcggccgggttgtccggcgaagtagagcagcaattgttcgatgccctgcaacgcaaggccatcgatgaagtggtcgctctcaccgagggtgtaccttcggatctggccggcatgctgcgtgcgctggtggatctgtgcggtggccgtgaagtgctgtcggctgcacgtgagcgcctggccaaggcgccagcgccggtattggccgcgctggatgacgtgctggcaatcgccgagcgcctgtcggcgcggttcccgcagctgccgctgtattttgatctgggtgagttgcgcggctaccactaccacaccggtgtggtgttcgcggtatttgtcccgggtgttggccaagccatcgcccagggtggtcgttatgacgatatcggcgctgacttcggtcgtgcgcgtccggccactggtttttccaccgatttgaaaaccctggtgaccctggggcgtgctgaggtcgagctgccgtctggtggcatctggatgcccgacagtacggacgcagcgctctggcagcaggtttgccagttacgcagtgagggtcagcgtgtagtccaggccttgcctgggcagccattggccgccgcccgtgaagcggactgcgaccggcaattgattcagcagaacgggctttggcaagtatcgccactggcttcttgagttttcctgccggccatcgccggcaccaagtttgcgcgaatgaggacaagtgttatgggtaagaatgtcgtagtcctgggcacccaatggggtgatgagggcaaaggcaagatcgttgatctgctgaccgaacatgctgccgccgtagtgcgctaccaaggtggccacaacgctggccacaccctggtcatcgatggcgaaaaaaccgtcttgcacctgatcccatcgggcgtactgcgcgaaggcgtgcagtgcctgatcggcaacggtgtggtggttgcaccggatgccctgctgcgcgagatcatcaagctggaagagaaaggcgtaccggtgcgcgagcgcctgcgtatcagcccgtcctgcccgctgatcctgtccttccacgttgcgctggaccaggctcgtgaaaaggcccgtggcgagctgaagatcggtactaccggtcgcggtatcggcccggcctacgaagacaaggttgcacgtcgtggcctgcgtgtgggcgacctgctcaacatgccgcgctttgaagacaagctgcgtgaactagtggattaccacaacttcatgctggtgggttactacaaagagccggccatcgagttcgaaaagaccctggccgagtgcaaggaatacgctgagctgctcaagccgctgatgctggacgtgaccgccgagctgcacgacctgcgtcgcgctggcaaagacatcatgttcgaaggcgcccagggttcgttgctggacatcgaccacggtacctacccgtacgtgaccagctccaacaccaccgctggcggcgttgccaccggttccggcgttggcccgatgttcctggactacatcctgggcatcaccaaggcctacaccacccgtgtcggttcgggtccattcccgactgagctgttcgacgacgtcggtgcgcacctggccaagcaaggtcacgagttcggcgcaactaccggccgtgctcgccgttgtggctggttcgacgccgttatcctgcgtcgcgctatcgatgtgaacagcatttcgggcatctgcctgaccaagctggacgtcctcgacggtctggaaaccatcaacatctgcatcggctacaaagatgcagaaggcaacgatgttgctccgaccgacgccgacagctacgtaggcctgcagcctgtgtacgaagaagtgcctggctggaccgagtcgaccgtgggtgccaagaccctggaagaactgccagccaacgcccgtgcctacatcaagcgtgttgaagcgttgatcggcgcaccgatcgacattatttcgacgggcccggaccgcaacgagaccatcgtgctgcgtcacccgttcgcttaataagctgttgatgtaaaaagcaaagggctccttggggagccctttgtcgtatctgcaggccaggcggcacgacccttgctgtgtttctctctttcgcggtgctatcaatttaatggcacccgtggtggagggattcccgatgtctgccgttctctcattgttacaaagccggctgttgcggccggtcttcgttacccttggtatcgctcttttggtgcaagtgctggtcgccgtcgctctgacccggagcacggtcactgcactggaggccgatttgagcaatcgcctgggtatcgacagccagaagctgtctggcgaattggcccaggcgggcaaggaagtcacctccagcctggacagcctgtctaccagcacccgccagcgtctgacggcggggctatctacgcgcttgcaggaagaacagaagcagctgcgtgcgaccctggaaaaagacttgcaggactccgccaatgatatggcgcagttgttggcctctgtggcccctcgcgccatgtgggacagtgatgtgccgacgctgtcggagttcgcccggcgtgcccagcgcaatcccaacgtattgtttgtggtttacgacgatgcagcgggggagcacctgacccgttacttgaaccgtgaaaacccaatcaaccaggtcctgctggcaaagggcgcaggtgagcgtgccctggacaaagtcctggatgcggcgaagacagatccttctgtgtattacgtcgaagcgtccatcagccccaatggcgtggaaatcggcaaggtacgcatgggggtatcgaccgctgcggtcgaggctgatctacaggctttggataagcgctttgccgcactgatcgccagtggcgatcaattggtaggcgacagcctcaagggcgctgcggctgatagtgccgccgccatgggcgcaaggttgcaatcggcacaagccactgccacccagatgaccgccaacaccgccagtgccgtgcaggaagctgcgggcaccctgcgctggcgtatcggcatgggcctggccttggtggggcttggcgtattgctgctgatcgccatcgtactcggtcggcgcgtggtcaaccgcttgaagctgctgatcgcggccatggatgacctggcggcgggcgagggcgatctcaccaagcgcgtgcagatcaacagcaaggacgaaatcggtgacatggcctcggcggtcaatcgctttgtggataagttgcaacccatcgtgcgcgaagcaggcgatgtggcccagcgcaccggtgtggagatcggtgcaatgacgttgcgcaatgccggcgccgatgctgccgctggcttgcagcgtgacgaagtggcggagagtttgcgcgcactctcgcaaatggctgacgaggctcaggccgaaagccatgcgatgcaggcggcgttgcaacaggtggtggatattcgccaggccacggatgaaaactcgcgcacttccgccgaagtcggcaacttgatcgaagcgttggcaggacaggtccaggccggttcccaggtcatcgagcgtctggcccagcaaagcgagcagatcgaagtcgtgctgactgtgatccacggcatcgccgagcaaaccaacctgctggcccttaacgcggccatcgaagcggcacgggccggcgagaccggtcgcggctttgcggtagtggcggacgaagtgcgggcgctggccagcaagacccaaagctccacaggcgatatccaggcgcatatcgtggcgttgcaacagggcgcgcgtgaggcggtggaaaccatcggcaaggctgggcgccaggccaatgaaggtttgctggtgttacgcgacagcgtgcgcttgcagcagacggtacaggcgtcagtggagcaggtgcacgcagccattggcctggcgacgcgtgcagccgagcatcaggcccagggcgcccatgcggtgcgtgggcgggtcgaggtgatccatgcccaggccgaacgtgcggcacaggcggtggtggagacgacggccagtggcaaggtgctggatgggttggcggcgcagttgaaggcgagcctggggcagttcagggcttagcctcgcctgtgccggcctcatcgggggcaagccccctcccacattggaacgcattccaaatgtgggagggggcttgcccccgatagcgatctcagcgactcagatacatccgagtcgtgagcaaatacaccggcaaccccgacaccagaatcagcagtgccgcataaggcgccgccgccgcaaactccacattcgaagtatgtgcccaaacggcagtcgccagggtattcagcccggtcggactgagcagcaacgtcgcggtcaactccttcatcgcatccaggaacaccagtgcaaacgccgctcccagcgccgggaagataatcggcaacgtcacccggcaaaacgcactgaacgacgaagcgcccaacgtgcgtgctgcctcttccaattgcggtgcggccttgttcagcgccgtgcgaatcggcgcctgggccaatggcaagaacagcagcgcataagcgatcaacagcaacgccgaggtctggtacagcaccggcacataatgcagggcgaaatacaccagcgtcagcgcaatcaccaagccgggcagagcatgcagtagatagggcaggcgttcggcccagatcgccagttgacctttgtagcgcaccaccagcagtcccaccggcaccgccagcaccaggcacagagctgcgccgcccagtgacagtgccagggaggacagcaacgcctcacctatctctgccatcggaaacgctgcagatgagcctacggccagccagtaaccgagcatccccaggggaatgccgctgccgatgatcgccagcccaaggcaatacacctggcccaaaggcgcccatttgcccaaccggacctgtgcggcatgtcgcgccgccccttggcctatgcgcacatgccggcctttgccgcgcacgcgcagctccagccacagcaaggtcaggcacatcaccagcaacaccgccgagagcattgcggcattggcattgctgaattccagttcgaattgctggtagatcgccgtggtaaaggtctgcaagccaatgatcgacaacgcgccgaactccaccagcatatgcagggcgatcagcagcgccccggccagcaacgacggccacagcagcggcaaggtgatgcgcagaaacacgccccagcggttcaggcccaatgtgcgggcggattcttccagggacggatcaaggttgcgcaaggtcgccgccaccggcaggaataccagcgggtacttggacaggctcatcaccaggatcgcgccgcccagcccttcgaagttggcgctcagcgacacccaggtaaagctgctgacaaacgccggcacggcaaacggcaggcacaggatcacgccccagatgcgccgtcctggcaggttgctgcgttccagtagccaagccagggacaggccgatcacgccgcaggtcacggtcacgccgaccatcagcgcgagggtgttgcgcagcaggccgaagacatacggccgccataacagatgcaccgcctctgcccagcccgcctgccaggccttgagcccgacatacgccaatggcagcaggctcatgccgaccagcaacagcaccggcaacaacagccagatcgaagggcgtttgcgccgggggctgaacgctgcggcaggtagcgatgggttcatcagttcaagccaacgtcacgttccagttccaaggcttcttcggcgttgccaaggtcggccggggtgactttcggcggttgcaactcgctaaatggcttgaggccgcggttggattccatgcctttacgcagtgggtactcggccgaagtgttagtgatcacgtgctggccttcttcactggccatgaatgccagcagttgctgggcttccttggggtgcttgctggatttcagtgcggcagcggaggacacggtaatcaggccgccggcatcgccatcagtgaagtagtgcagttgggagtccaggttggttttctccttcttcagggcaaaccagtagtagttgttcaccagtacggtggccacttcgccgttttccacggccttgagggcgaccatattgttgctgtacaccttgccgaaggcgcgcaggccggtcagccattcttccgcggcttcacggccgtgcagcttgatgatcgccaccgcttgttcctggaacgcgccgctggtgggtacgaagccgaccttgccttgccactcggggccggcgaagtccaataccgacttgggcaggtctttttcagcaatcagttttgggttgaaagccacgacgcgggtgcgggcggtcacgcccatccaatcgccgttacggccaacgtaatccttgggtagtacatcgagggtgctggtatcgatcttcgccagcaggccttgctcgccgagtttgttcagtggcggcgactcttcggtatagatcacgtcagcaggggaacggtcaccttcttcgacgacctggctggccaactgattgctgctgcctttacgcacgttaacgtgaatgccagtcttggcttcaaaagctttggcgagttcatcgccgacttccttgtgctggccgttgtacaaggtcagggcgatcttgtcggcggagtaggcggtgggcgagagcagggtcaggccaagcagggtgaggctcaggccacgcagaagggatgtcttgagtcggttatcgcggatcatcatccgaagtgttcctcgctatatgcaacaaatcattgcaaggataaacgataaaacttctcaagtgcggatgagggggaaatcactggggagtttttctggcgtcagaaacgaaaaaacccgctttcgcgggtttgatctgaatttggtgcccaggagaagactcgaacttccacgaccttgcgatcaccagcacctgaagctggcgtgtctaccaatttcaccacctgggcattatcgaacaacgttgccgctgttgatggggcgaactatacggcgggctttttgttctgtaaacccctgattcgaaaaatataaatcaattttccctttaaaaatcaaaggcctgaaacgaaaaaacccgctttcgcgggtttgatctgaatttggtgcccaggagaagactcgaacttccacgaccttgcgatcaccagcacctgaagctggcgtgtctaccaatttcaccacctgggcattatctgacaacgttgccgtcgtcgatggcgcgcactatacggagcgatatttacgctgtaaacccctgccatgaaaaaagcctggaaaatttcgccagtggtcgtgcaaggtgcgcgccgggggtcgcaaagggcttttaaacgcttgttgatacctgaaatttcccgtttcaatacgcgtatgccaaactaacccgcatatagacaaggtgaaaactctctaatggccgattggcagtccctcgatcccgaggccgctcgtgaagcggaaaaatatgaaaaccctattcctagccgcgaactgatcctggcgcacctcgccgatcgtggttcgcctgctagccgcgagcagttggtcgaagaattcggtctgaccaccgaagaccagctcgaagccctgcgccgccgcctgcgcgccatggagcgcgacgcgcaactgatctacacccgccgcggcacctacgcgccggtggacaagctcgacctgatccttggccgcatcgccggccaccgtgacggatttggcttcctgatcccggacgatggcagcgacgacctgttcatgagccccgcgcaaatgcgcctggtgttcgacggcgatcgtgccctggcgcgggtttccggcctggaccgtcgcggtcgccgtgaaggcgtgatcgtcgaagtggtgtcccgtgcccacgagtccatcgtcggccgttacttcgaagaaggcggcatcggctttgtggttccggataacccgaaggtgcagcaggaagtgctgatcacccccggccgcaacggtgccgccaaggtcggccagttcgtcgaggtgaaaatcacccattggccaacggcgcgcttccagccccagggcgatatcgttgaagtggtcggcaactacatggcgcccggcatggaaatcgacgttgcgctgcgcacctacgatattcctcacgtctggcctgatgccgtgctcaaggaagccgccaagctcaagccggaagtcgaagagaaagacaaagaaaaacgcatcgacctgcgtcatctgccgttcgtcaccattgacggcgaagatgcccgtgacttcgacgatgcggtctactgcgaagccaagcctggcaagctgcgcctgttctccggcggctggaagctgtacgtcgcgattgccgacgtgtccagctatgtgaagatcggttcggccctggataacgaagcccaggtgcgcggcaactccgtgtacttccctgagcgcgtgatcccgatgctgcctgagcagctgtccaacggcctgtgctccctgaacccgaaagtcgaccgcttggccatggtgtgcgagatgaccatctcgaaaaccggcgagatgaccgactatcaattctacgaagcggtgatccactcccaggcacgcctgacctacaacaaagtcagcaccatcctggaaacaccgaagaccagcgaagccaaggccctgcgcagcgaatacgccgacgtggtgccgcacctcaagcagttgtacgcgctgtacaaggtcttgctgggcgcccgccatacccgtggcgcgatcgattttgaaacccaggaaacccggattgtcttcggttccgagcgcaagatcgccgcaatcacgccgaccacccgtaacgacgcgcacaagctgatcgaggaatgcatgctggcggccaacgtggccactgccgagttcctgaagaagcatgaaattccagcgttgtaccgggtgcacgacggtccgccgccggagcgccttgaaaagctgcgtgcgttcctcggtgagcttggcctgtccctgcacaaaggcaaggacggcccgacgccgaaggattaccaggcgctgctggccagcatcaaggaccgtccggattaccacgtgatccagaccgtgatgctgcgttccctgagtcaggcggtatacagcgccgacaaccagggccatttcggcttgaattacgaggcgtacacccacttcacctcgccgattcgtcgctacccggacctgctcacgcatcgggcgatccgcagcgtgatccactccaagcagaacaccccgcacgtcaagcgcgccggtgccatgaccattccgaaggcacggatctatccgtacgacgaagcggccctggaacaactgggcgagcagtgctccatgagtgagcgccgcgccgacgaagccacccgcgacgtggtgaactggctcaagtgcgagttcatgaaggatcgcgttggcgagacgttcccgggtgtgatcaccgccgtgaccggttttggcctgttcgtcgagctgaccgacatctacgtcgagggcctggtgcacgtcaccgccttgccgggtgactactaccacttcgaccctgtgcatcaccgcctggcgggcgagcgcaccgggcgcagcttccgcctgggcgataccgtggaagtgcaggtcatgcgcgtcgatctcgacgagcgcaagatcgacttcggcatgcctgacaagcccgcagagccgactggccgtaagaaacgtggcagcgaaaccgcggcgccgactgccaagggcaaaggggctcctgcgaaagcggcagtcgccgagcctgcaccggccaaggccggtcgtcgttcttctgccaaggacaaggctcctgaagcctaccgcccaagcgatgccgcggcgaaaaacgccgagctgcgcaagagtcgcgagttgaagcagcagctgctcaacgaagccaaaagcggtggtaaagcggcgcctgggggaaagtcccaaggggcggaaaaaccgtcgagcaagccgagtaaacaccgtaaaggcccgcccaaagcgggttcggcccccgcgaagagcggcgggtcgcgcaaacctaaggccaagtcatgagtctggaaaaaatctacggcgtgcacgccgtagaagcactgctgcgtcaccatcccaagcgcgtcaagcaggtgtggttggccgaaggccgcagcgagccgcgtgtacaggcgctggtcgagctggccacgcaaaacaaggtggccatcggccaggccgagcgtcgtgaaatggacgtctgggtcgaaggcgtacaccagggcgtggtggcggacgtcagcccaagccaggtatggggcgaggccatgctcgacgagctgctcgaccgtaccgaaggcgcgccactgctgctggtgctggacggcgtgaccgacccgcacaacctcggcgcctgcctgcgttcggcggacgctgccggtgcgctggcggtgatcgtgcccaaggacaagtcagcgacccttacgccagtcgtgcgtaaagtcgcctgcggcgcggcggaagtgattccgctggtggccgtgaccaacctggcgcgtaccctggagaaactccagcagcgtggcttgtgggtcgtgggtacggcaggcgaggccgaggtcagcatttatgaccaggaccttaccggcccgaccatcctgatcatgggcgccgaaggtaaaggcatgcgtcgcctgacccgtgagcattgcgattacctggtgcatttgccgatggccggtagtgtcagcagtcttaacgtatcggtagcgacgggtgtttgcttgtttgaagctcagcgccagcgcggtgccaaggtcaaggccaagaagtaattctgagcctggcacagaatcaaaatgtgggagggggcttgctcccgattgcggtgtatcagtcagctgatgtttggctgacacactgctatcgggagcaagctccctcccacattggcttccggtgtcagtaaccattgttcaaataatcaccaatcaccttgcgccgcttctcccccttctctacaattgcgccccttgccttcctggcaggcacgcatgtgcctcccctgcggcaagatccataagtgtcattcactccttgtctgaccgtttttgagcggcaggctacaacccgtaaggagcattcatgcgtcattacgaaatcatctttttggtccacccggatcaaagcgagcaagtcggcggcatggttgagcgttacaccaagctgatcgaagaagacggcggcaaaatccaccgtctggaagattggggccgtcgtcaactggcctacgcaatcaacaatgttcacaaggctcactacgtgatgctgaacgttgagtgcactggcaaggccctggccgagctggaagacaacttccgctacaacgatgcagtgatccgtaacctggtcatccgtcgcgaagaagccgttaccggccaatccgagatgctcaaggctgaagaaaaccgcagtgagcgccgtgagcgtcgcgaccgtcctgagcacgaaggcgctgatagcgctgatagtgatgacagcgacaacagcgataacgctgacgagtaatccacggaccttttaaggagcctatcaaatggcacgtttcttccgtcgtcgtaaattctgccgcttcaccgctgaagacgtgaaagagatcgattacaaagatctcaacactctgaaagcctacgtatccgagaccggcaaaatcgttccaagccgtatcaccggtaccaaagcacgttatcagcgtcagctggccaccgctatcaagcgcgcccgcttcctggccctgctggcctacaccgacagccacggccgctgagaccgggcagtcgacaagtagtaagggattgaatgcatgcgcgccttagctgagttcatcatgcgcggtcgtgtgcaggccactctggtagtggctggctgtgcggcattgccgttgctttattggttgggtgctgccgcgggttgccttgtgctgctgcggcgcggtttgaaggacgcccttggcgttcttgccctgggtttgttgccggccttgatctggtggctgcaaatgggtgatccacgggtacttctggtactgctggggtcatcgagccttgcgttggttctgcgcgcaagtgagtcctgggtccgcacgctgctggtcagcgtggcattggggttggtgtactcagtgatgcttggcgcggctttccgcccgcaaatcgaggcgctgtcgcaggaaatcgtcaagatcctgccgctggccctcggggatctctaccagcagttgtcggtagatgagcgagcgcggtttgcgtcactgattgccccggtcctgaccggcctgattgcggcattgttgcaggtcgtcagcgtgctgagcctgattcttgggcgttattggcaggcgttgttgtacaacccgggtggttttggtcgcgagtttcgcagtatcagaatcccagcggggccggcgatgttgctgctggcgtgcatggttgtcgggccgaacttcggcccacagatggccttgctggcgccgatttgcagcgtaccgctggtgtttgccgggctggccctgatccatgggctggttgcgcgcaagcgcctggccaggttctggctggtggggttgtacgtcacgctgttgctgttcatgcagctgatctatccgttactcgtggtcttggccattgtcgacggcctgattgattttcgcggtcgtctggcatcgaaagacgccgataacgcgaacggtgaaggttaaaagttagaggattttcacatgcaactgatccttctggaaaaagtcgccaacctgggcaacctgggcgacaaagtgaacgttaaggccggctacggtcgtaactacctgctgccatacggcaaagccaccgctgcaaccgctgccaacctggctgcgtttgaagagcgtcgcgctgagctggaaaaagccgcagcagacaaaaaagcttcggccgaaactcgcgctgcccaactggctgagctggaagtgactatcactgccaccgccggtgacgaaggcaagctgttcggttcgatcggcacccacgacatcgctgatgcactgaccgcctccggcgttgaagtgcagaagagcgaagttcgtctgccgaacggcaccatccgcaacgtaggcgaattcgacgtagccgtgcacctgcacgccgaagttgaagccaccgtacgcgttgtcgtggtagcagcttaagtcgcacctaactgactggcacctcgcgtgtcagccggttaacatcgggcacgatcctgtttacaggtcgtgccttttgtttttctacacacccccaaatttcaagtggccatgaacgaaatctccgctcctgagcaatacgatctgcaaaccgctgccctgaaggtgccgccgcattccatcgaggccgaacaggccgtgctcggtggcttgatgctggacaacaacgcctgggaacgcgtgctggatcaagtctcggacggcgacttctatcgtcatgaccaccgcctgatcttccgcgccatcgccaagctggccgaccagaactcaccgatcgacgtggtgaccctggccgagcagttggacaaggaaggccaaacctcccaggttggcggcctgggctacctcggtgaactggcgaaaaacaccccgtccgtcgccaacatcaaagcttatgcgcagatcgtccgcgagcgcgccaccctgcgccagttgatcggcatcagtaccgagatcgccgacagcgcctttaaccccgaaggccgcaccgccgccgagattcttgacgaggccgagcgccagatcttccagatcgccgaggcacggcccaagaccggtggcccggtcagcgtcaacgacctgttgaccaaggccatcgaccgcatcgacaccttgttcaacaccgatgccgccattaccggtatttccaccggctacaccgacctcgacgaaaagaccagcggcctgcagccgtccgacttgatcatcgtcgccggccgtccgtccatgggtaaaaccacctttgcgatgaacctggtggaaaacgccgtactgcgcagcgacaaggcggtgctggtgtactccctcgagatgccaggcgaatcgctgatcatgcgtatgctttcgtccctggggcgcatcgaccagaccaaggtgcgttccggccaattggaagacgacgactggccgcgcctgacctcggcggtcaacctgctcaacgaccgcaagctgttcatcgatgacaccgccggtatcagcccatccgagatgcgtgcgcgtacccgccgcctggtgcgtgaacacggcgacatcgcgctgatcatgattgactacctgcagttgatgcagatcccgggttccagcggtgacaaccgcaccaacgaaatttccgaaatctcccggtccctcaaagccctggccaaggaattcaactgcccggtggtggcgctgtcccagctcaaccgctccctggaacaacggcccaacaagcgcccggtaaactccgacttgcgcgaatccggagcgatcgagcaggacgccgacgtgatcatgttcgtgtaccgcgacgaggtgtatcaccccgagaccgagcacaaaggcatcgccgagatcatcatcggcaagcagcgtaacgggcccatcggctttatccgcctggcgttcattggtaagtacacccgtttcgagaacctggcaccgggcagctacaacttcgacgacgatgagtagcccgccgtcaatttgccttgctgaacagctgtttgatcattttttcgtcataaccgtagtcccagcgtaactccgtgccggctgccaaatcctcggtggcaaagaaggcgctcaggcgcaggcgcatccgcgactggtcggcggtcagcacatcgacgataaacctggcgtcttcgacgttgtagccggtcttggcttgcctgaccggtgtaccgttgctgtactcgaacatcgtgttaatccgcgacagtacgttatcgccggaaaaactgagaaaggcgctgaccattttcggtgtctgcgtgctgcctacttgcgcgccaggctgcgcccatgtgtgcacatccagcaaatagggatcgcgacgctgttgggcgattcgcgagggcaccagctcgccgccgtacacccccagcgcttcgcccttggcaatcgccttggtggtcaccactgtggactggccgagcaggctggcttcttcgggaaacttctgatgtgcggcggtgaagggcgttaccgttaatttttcgtcatataacgccgcgactttctcaaagccttcccactcaatgaacggcatgatcagggccttgctgtaggccttgccgcttctcgtgcggccggtggcctggatcgatttgatccgcagcggctgtccctcggtatcgcgcaaggggtagcggccattgttggcgcgttcgaaactgccgagatgattggcactttgctggtagctggcggatgagcgcatgtgctgcaattcgtccgccgtatacacgatggcgccttcgtcggccgactcatagtcagtggcgggttcggcggatacaaaggtttcgctggagtcgcttggcgccgtgccttcgaagtcaggccttggcacgccaccgaatggcgtggcgacggtgccgtccagttcccagccgctctcgctgtgcttgcgcagatacggctggtacgccctgaagtggctgcgtgcgtcgatcagtcgccaaccactgtcatcggcctgcacccggtagtatcgggcgttatccaggatgtaatagcggtagctgccgtcgggcaggacgggcgcctgatagatgccgtccgccctcagcgtgagccccgcaggcggggctgggtcggcaaatgcgggttcgatgcggtgccgcttgggaaacgaatcgctgcgtttgaacggtgcacgcttagcgattaaaccctgcgccatacttttttggctggatttacgcatggcctccttgagggtgctttcctgggcttggcgcagcacggcgtcgagctctgtgggcggcagtacatggctgatggcagtgggcaggtcactgggttcggccagcgtccggccctggctatcccgtgggcgatagtgctggccttcacggatgatcagcaagcgctggctggcgtcgcctgtgccgctgctgcataacagcgggccgctggtgccgatgtcgcgcacttccaggcggcgggagaggggccaaccgggcaattgttccagggctgcgagcatcatttccggcgtttgcggcgtggacattgactccaggtgcaggctggcgagcagccggctggcctcggcttgttgcaggtactggtcggcttcccagtgttgatgccgggtcaggcttttctcacgcagtaacctgccacgctgttcggggctgagtaccgaggccatttcttcgacctggcttgccggcaagtccgggaccagcttaccgatctcctgctcgacgccgctgccgggttgcttcaaggtctgctccagccaagtaaacagacggtgcgaatgttcaggtaccgtttggctcaaacgctgggcaaggttctcgacatgggtccggtgcggggcgggctcagcgggcagcagctcgttgaattcggttgtgggcagtgcgctctccaggcaatacagcaactcacctttcctgaaacgcgccagcggtaccttgatggcttgtgtgccaccgcccaggctgatcaaggtcttgccctgctcatcgacaatattcaccatccgtccgctgggccattcggggagtgagcagacctcatggagctggatataaggtgtgcagggcgtaagcgtcgaaccttcggcgcgatcggcgtcgaaactgttgatctcctcttccaggttgaactgcttgagtgtttcgcgcagctgcggtggtgggcgcagcgattcctggtgcgcccggcgcagggtgctgctgttggccccccccaccagcagcagtggctcgacctgggcctgggtgatgttggcggcgtctggcccaaggcgtttgatcagcttgaggtcgtcccaggcccgtggtgtctcgtgggcatgccgccaaccaccggtgccgttaccgtgcagtggtggggtgtaggcgtcgggatcgctgggatgctgcagttgccattgctggctgcccgggtcgcgcttgaccgcatgcaggcggtcgtcgagtttcacataggcttgccctgcgtggttatacacaccctcggcatcggcgggtaacccgccgggcaaggtgctctccagatgacggtaaggcgcaaggtccgggttccacaggcgttcacgtccgccgcgcagcctgaccttgaccaaaccggcggaaaaccccaccgccttgaccgcgccagcggtgatgacggcggtagtggccgcgtccaccacatccatcaggtcctcgagggcttcgtcgctgtcgccccggctccaggcggcaaacccgttatagacagtgccgagcaactgcgccgcactgaccgccagtaagacctcgcctacgaccggcacgaatgaggcggcaaagaacagcaccgactttcccagctccagataggactgcaagcgcttttgccggctggccaggtccgcatccgcggtgggcactaccagtgcgcgtgcgtcttgtttgatttgctcgatgcgatggcgggtaatggccaggaacacatggccgcggatggcgctatacgtcatgggttttgccaggctggccggtatcagtctgccggtagcccctacggagaaccagtctcgccaggcgggtcgcacctcgagcagggtttctcggtgacgcaagggcaccaggcgcttgaaaaacgccaggtaggcgggcgtgttgatcagccgatcagccagttgctgattcaagtcttctgcgtccgtgtgcaagcgcaagggggccgccggatcctccggtacgtagagcaactgttgcgggttttcactgccccattcgaacaccagcacgttgggcagcacgaccgcattgagggtgaggtgactgcagcgcacctgcggatggctgccgtcgcgcaccagcgcgagcaactgctcatagcgttcttgggtaagcacattgttcagccgcgccacgtgcagtgacaccgcgaggctatgcctttctttttcgacaaacagcctgcgcacgtacgaggtcatggtcagggtatgggtggggcccagtacctgttcgacgtggtactggtaataccggccaatatccaggtcgcggcacagtttggccaattgctgcggcgtcaccgagctaagcttgcggtcacctccggcttgggtatagatgcctgagccggcctcgatgcccttgccttcggcctcgtctgcttcgaagttttgtagcgccacctccaacaggctctgctccgtggtgcctgcggccgtcttgaccaggcccagcacgtggtggtgcttccatttgcgcaccaggagcgcggactcattgatccgctggccgggaaacttgcgttgcagggcttgcctgagcatgggccgcgcataggcttccgggcttttgaggctgcgcagatattccttgaaatcatgcctggcctgattgctcttgagcaggctttcgcgcagcgccttgcgtatctcctcgggcgccagtgtcagccaggccggcagttgggcgcggataaagcctgcgtgagtcgaaaacgcaggtgtgggattgctggtcatcaggggctccaaatgcatcgttatttggggccagcctatccacggttttcgccgctggaggttatctacttgttacccgtgcgtgcgcaaaagctgggcgcctggcggggtaggagacggccaggattaaagccgaccattgccgtcggaattggtcaaaatttgtgctatattccgcgcccgcgatttttcatctcaacaccggtcaccgtcatgcaaacagccaagccgttatttgactatcccaagtactgggccgaatgtttcggtcctgcgccattcctgccgatgagcagggaggagatggatcagcttggctgggattcctgcgacatcatcatcgtcaccggtgatgcctacgttgaccatccgtcgttcggcatggcaatcatcggccggctgctggaggcccagggcttccgcgtcgggatcattgcccagccgaactggcagtccaaagacgatttcatgaagctcggcgagccgaacctgttcttcggtgtcgcggccggcaacatggactcgatgatcaaccgctacaccgccgacaagaaaatccgctccgacgacgcctacacccccggtggcatggccggcaaacgcccggaccgcgccagcctggtgtacagccagcgttgcaaggaagcctataagaacgtaccgatcgtactgggcggcatcgaagcctccctgcgccgcatcgcccactacgactactggcaggaccgtgtgcgcaactcgatcctgatcgacgccaccgccgatatcctgctgtacggcaacgccgagcgtgccatcgtcgaggtggcccagcgcctgtcgtggggccacaagatcgaagacatcaccgatgtgcgcggcaccgcgttcattcgccgcgacacaccggcgggctggtacgaagtggactccacgcgcatcgaccgtccgggcaaggtcgacaagatcatcaacccgtatgtgaatacccaagacacccaggcctgcgccatcgagcaagagaaaggcccggtggacgatccggaagaagccaaggttgtgcagatcctggccagcccgcgcatgacccgcgacaagaccgttatccgcctgccctcggtggaaaaagtccgcggcgacgctgtgctctacgcccacgccaaccgggtgttgcacctggaaaccaacccaggcaatgcccgcgccctggtgcagaagcatggtgaagtggatgtgtggttcaacccgccgcccattcctatgaccaccgaagaaatggactacgtgtttggcatgccttacgcccgcgtaccgcacccggcgtacggcaaggagaaaatcccggcctacgacatgatccgcttctcggtgaacatcatgcgtggctgcttcggcggctgcaccttctgctcgatcaccgagcacgaaggccgcatcatccagaaccgttccgaagagtcgatcatccgcgagatcgaagagatccgcgacaaggtcccgggtttcaccggtgtgatttccgacctcggcggcccgaccgcgaacatgtaccgcatcgcctgcaagagcccggaaatcgaatccgcgtgccgcaagccatcctgcgtgttccctggcatctgcccgaacctgaacaccgaccactcgtcgttgatccagctgtatcgcagcgcccgtgctttgccgggtgtgaagaagatcctgatcgcttccggcctgcgctacgacctggccgtcgagtcgcctgaatatgtcaaagagctggtgacccaccacgtgggtggctacttgaagatcgccccggaacacaccgaggaaggtccgctcaaccagatgatgaagccgggcattggcagctatgacaagttcaagcgcatgttcgagaagtacaccaaggaagcgggcaaggagcagtacctgatcccgtacttcatcgccgcccacccgggcaccaccgatgaagacatgatgaacctggccctgtggctcaagggcaacggcttccgtgccgaccaggtgcaggcgttctacccctcgccaatggctaccgccacggcgatgtaccactcgggcaagaacccgctgcgcaaggtcacctacaagagcgacgcggtgaccatcgtcaagagcgaagagcagcgccgtctgcacaaggcgttcctgcgctaccacgacccgaagggctggccgatgctgcgtgaagcgctgacccgcatgggccgtgccgacctgatcgggccgggcaaggaccagttgatcccgctgcaccagccggctaccgacagctaccagagcgcccgtcgcaagaactcgacgccggccggcagccacaaggtcgccaaggaaaccacgaccaaaatcctcacccagcacaccggcctgccaccccgtggcagcgacggcagcaacccgtgggacaagcgtgagcaagccaaggcagcggcccaggcgcgtaacaagcaagcggcgaaggaacgcaccgatgcggccaagggcaaaggcggcaagcctgcgcgcaagccggtggtaccgcgttgatcgctgcttgaacctacaaaacgccagcttcgtgctggcgttttgctttctggtcggtggtgagtctgtttggtaaggtggcgcccattagatcgctatcgggagcaagccccctcccacattttgaatgtattcacacattaaagtgtgggagggggcttgctcccgatagcgtcagtccagtctccaccctttcaaggaagaacaccccatgggcaaccccctggccggcatcggcatggactctaaccgctcccagttcatggcgcgccagcgcatcgaaagccagatcaacctgccgcggctgtttgcggccattgacgccgatccaggtatcgttggcgcaggcgtcgtatacatcgacgccgacttcaacgtcattaccctgcgcgaattcaagcccatctgcagcatcaagcccaagcgcatcattttgcgtgaagcgcagaagtacattgcgccaacgcagtttgctcaacatgtcgtgaacaatcctcgagaatcgcgactgattggcgaagccgtgaataccggaatctcctgttttggggctgtcatcagttgggctgcgatcgccagtggaacaattctggtgcctttcagtgccggcgccagttccgtcatcgtcgtggtggggtatgcggctgccggcgcaagttcgcttcagtgtttcaacggcattgcccggacagcgctggaggtcgccaagcctgaggtaaaggattggctcgacagtgagggctggtaccagaatgcttccattgtgctggacgcagtatcactggtaggcgtgagcgcttcggccctgacgacggtcaagctggtcagggccgccaaagcatcgacgggcaagagtctgcgtgacgtgcttcgcgggttgaatcgccaggaaagagccaagctcacgaaagagctactcagcatcaaccatcccagcttgactgcgaagatgctcaaattgaagcaggcgtcgggtgaactcaccaagcgtttcacccctacgcagctcaagcacagcaccactacccagatcaaagacgtcctgggcgcaagcatagggtttggcgggagtgcgtactccggaaacgtcaataccatagcgatagggttgtacgaggaaataaacgaatgaacgagttaatgacgctacgcgactttttcaggcaatactttctgacgtttatgggcggcgtatttgctgcgtatttttctttggcattggctgtggcgctggcgttcgtcacttattttcgtgatgtgccgctggctcaagtggggctcaagatcatgttggtcggggcgctgctcattctgttgacggtccatagtaactttatgatgttgcggggccgaccctcctgggtgtgggtaatggtcggtatctatgtcgcctgtctactgtttgtcgttccgatggttcaattccggcctcacaaagttctttatgggttggcgctgttattcccattgctcggattattgacacttaatagcaaggttcaacgagagatgcgcacgaaactcgtggaaatccgtcgcattcggcagtctgtcaaatcaaccgtcagatcgagtagtcgcatgtgaaggagccgccttcgttaaacagattcctggcgcgctatttccccgtattcatggggacgattttcatggcgatcttctccggctcagccgcggtttccatggctggcgtgacctatttgcgctgttggggttactgctgctcaacagcaaacgccaccgcgaaatgcgcaaaaaactgtccgagatacgccatctgcgccaaaccgcaatcgcaaagcgcaaagcccgttgattgggtagattcaccatccatcctcacactgacgccacaaatgtgtgcggctcttgcaccgtggtacgtatgttggcgccgttttggtgctgtactgcaccgggtcccacgataaagcgcaatgaccgccgccctggcataagtcttgcgcgcgttgtgcttatgccctggctcgcaggaggccgccgtgtcgattcatgttgcgttgcaccacgttacgcactaccgctacgaccgcgctgtcgaactcggcccccagatcgtgcgtttgcgcccggcagcccatagccgtacgcggatcttgtcctacgcgttgaaagtgctgcccgagcagcattttattaattggcagcaagacccccagggcaattacctggcgcgtctggtctttccggaaaagacggacgaactgcgcatcgaggtcgacctggtcgccgagatggcggtgttcaacccgttcgattttttccttgagccgtatgccgaaaaaatcccgttcagctacgccgccgatgagcaacgcgaactggcgccgtacctggaaacgttgccgctgacgccaagattcgccgcgtacctggccggtatcgaccgtacgccattacctgcggtggatttcctggttgggctgaaccagcgtctggccgccgatatcggctacctgatccgcatggagccgggcgtgcaaaccccggaattcaccctggaaaacgcctccggctcctgccgcgactcggcctggctgctggtgcaattgctgcgcaacctggggctggcggcgcggtttgtctctggttacctgatccagctcaccgccgacgttaaggccctcgacggcccttcgggcaccgaagtcgatttcaccgacctgcatgcctggtgtgaagtgtatttgcccggcgccggctggatcggccttgacgcgacttccgggctgttcgccggtgaagggcatatcccattggcctgtagccccgatccatcttctgccgcgccgatcagcgggttggtggagccatgcgagtgcgaatttgcccacgagatgtcggtggaacgcatctgggaagcaccacgggtgacccagccctacaccgaagagcaatggctggcgatccaggccctgggccgacagatcgacgctgacctgctcaagcacgacgtgcgcctgaccatgggcggcgagccgaccttcgtctctatcgacgaccctgacggcgccgaatggaacacggccgccctggggccggacaagcgtcgcctgtccgccgagctgttccaacgcctgcgccggcactatgcgcccacgggcctggtgcatttcggccagggcaagtggtaccccggcgagcaactgccgcgttggtcgcttaactgttactggcgccgagatggagtgccgatctggcacaacagtgcgttgatcgccgatgaacaagaggattatggtgctgacggcgcgatggcagggcgcttcctggccagcatcgccgaacgcctgaaactgccggcgcgctttgtgttcccggcctttgaagacaacgtctactacctgtggcgcgagggcgcgttgccgcataacgtcagcgcccaggacccgcgcttgagcgacgaactggagcgcgaacgcctgcgcaaagtcttcgctcagggcctgggtaacgtcatcggccacgtgctgcccctggcgcgcaccgcggccaatgaccgctggcagagtggtcgctggtacctgcgcgataatcactgccgcctggtgccgggcgattcgccgctgggctatcgcctgcctttggcttcccaaccgtgggtgacggcggtggagtatccgttcgtgcacccgaccgaccctaatcaggatcaacctgacctgccgaccaccgaacaactgcatagccacggcgagccggccccgagcgatgagcgtgtgccgaaggtcgatgagtccgctgactggctgacccgcaccgcgctgtgcgccgaagcgcgggaagggcgcctgtacctgtttatgccgccgctggaacgcgtcgaggattacctggaactggtggccgccatcgaggccaccgccgaagaattgcattgcccggtgctgctggaaggttacgagccgcccgcggatacgcgtttgagcaacttgcgggtcacgccggaccctggtgtgatcgaagttaacgtacagccgtccgccacctgggacgagttggtggaacgcaccgagttcctctatgaagaggcccggcaaacccggctgaccactgagaaattcatgatcgacgggcgccacaccggcaccggtggcggcaaccattttgtgctgggcggcgcgacgcccaaggactcacccttcctgcgccggcctgacctgctgcgcagcctgatcagctactggcataaccacccgtcgctgtcctacttgttctccggtctgttcatcggcccgacctcccaggcgccaagggtggacgaggcacgcaacgatgcgctgtatgaactggaaatcgccttcgcgcagatgcctgcaccgggcgaggaatgcccgccgtggttagtggatcgcctgctgcgcaacttgctgatcgatgtgaccggcaacacccatcgcgccgaattctgtatcgacaaactctactcccccgacggcgccaccggccgcctgggcttgctcgaattacgcgcctttgaaatgccgccccatgcacgcatgagcctgacccagcagttgctactgcgcgcgctggtcgcacggttctggcgcgagccttacgcgccgccgaaactggcgcgctggggcaccgagttgcatgaccgtttcctgttgccgcattttatcgagcaagactttgccgacgtgatcgtcgaactgaatgcggccggctacccgttgcgtgccgaatggttcgctgcgcacctggagttccgcttccccaaggtgggcgactacgccgtcagcggtatcgaactggaactgcgccaggccttggagccctggcatgtgctgggcgaagagggcgcggtgggcggtacggtacgctacgtggattcgtccctggagcgcctgcaagtgaagttgactggcctgccagcgcaacgctacctgctgacctgcaatggcatcccggtgccgctgcaaccgaccggccgcgtcggcgagtttgtcgctggcgtgcgctaccgcgcctggcaaccggccaactgcctgcaaccgaccatcgcggtgcatgcacccttggtattcgacctgctcgacacctggatgcagcgctcgctgggcggctgccaataccacgtggcgcatccgggtggacgcaattacgacagcttgccggtgaatgctaacgaggcagagagccggcggatggcgcggtttttccgcttggggcatagcccgggcaagcgaccggtgccggttgtagaggtgaacgatgaaatgccaatgaccctggatttacgccgttttccaacaaataaggaatgaatgcgagccaactgtggaagggggcttgctcccgatagcagagtgcagtcagcacatttgtcactgatgcaccgccatcgggagcaagccccctcccacattggatcgtagtgaatttgagttaacctgacttcccttgcccctgccgagcgttccatgtccgatttgctcgaccgttacccgctcaccgcgggcacctaccacgaactgctggacgccagcggcgcggtgcgtgcccattggcagcgtttgctcgatcacctgcaacgcagcacgcccacgcaactggcccagcgccaggcgctgctgacccggcaaatccaggaaaacggtgtgacttacaacgtctacgccgaccccaagggcgctgatcgcccctgggagctggacctgctgccccatgtgctggccgccgatgagtggcggcagctgtcggccggcattgcccagcgtgcgcgcttgctcaacgcggtgctggccgacctgtatggcccgcagcgcctgatcaaggaaggcttgctgcccgctgaactggtgttcgggcataacaacttcctgtggccatgccagggcatccagccgcccgacggtgcattcctgcacttgtacgccgtggacctggcgcgcactccggatggccgctggtgggtcaccgccgaccgtacccaagcaccgtcgggcgccggctacgccctggaaaaccgcaccatcgtgtcccgcgcgttcccggacttgtaccgtgatttgcaggtgcagcacctcaccggtttctttcgcacgctccaagaaaccctggcccgccaggcaccgggcgacgaccagccaccgctgatcgtgctgctcacgccgggccgtttcaacgagagctatttcgaacacctgtacctggcgcgccaactcgggtacccgttggtagaaggcggcgatctcaccgtgcgcgacagcacagtgttcctgaaaaccctcagcggcctgcgtcgggtccacgcgatcatgcgccgcctcgacgacgatttctgcgacccgctggagctgcgtaccgactcggcccttggcgtgcctggcctgctcgacgccgtgcgccaaggcaacgtgctggtggccaatgccctgggtagcggcgtgttggagtccccaggcttgctgggtttcttgccaaagatcaacgaattcctgttcgatgaagcgctgatcctgccgtccattgccacctggtggtgcggtgtagcgccggtgctggccgaagccctggaaaaactctcggagctgctgatcaggccggcatttgcttcgcaaagtttcgccccggtgtttggtcgcgacttgaacgatgagcaacgccaggccctggccgagcgtatgtgtgctcggccttacgcctacgttgcccaggagctggcgcagttgtcccaggcgccggtgtggcataccgaggaagaccatctgcaacaccgcgccatcggcatgcgcgtgtacgcggtggccagtgatgagggatatcgcgtgctgcccggtggcctgacccgtgtggccgccgaggccgatgccgaagtggtatcgatgcagcgcggcggcgccagcaaggacacctgggtgctgggtgaacgtgccagcgtcggcgaacagtggcgtgcccagcgtgcgattggcgcccacgacctggtacgtcgcgacccttatttgccgtcgcgggtggtggaaaacctgttctggtttggccgctattgcgaacgctgcgatgacagtgcgcgctggctgcgtatcgtgctggcgcgttatgtggatggcgatgatccgttggcgttgcaggcagcggtcgaactgggagaaaacctgcgcctgctgccggaggagggcgagctgcccgagcgcctgctcgccgccttgctcggtgatgattggccttcgagcctgcgcgccaacttgcagcgcttgcagtgggcggcgtcccaggtacgcggcaagctgtcccgggaaaactggcaggcgctggtggagctgcaacgcgaagccatggagctggaaagccaaacccctgattttggcgagctgctggatttcctcaaccgcctggtgatgtccctggcggcgctgtccgggtttgccctggacgacatgacccgtgatgaaggctggcgtttcttgatgatgggccggcgtatcgagcgcctgcagtttctcagcagcagcctggcagcgttcctgcgtggtgtggcggtgttcgatcaggccgggctggagtggttgctggaactgggcaacagcagcatcacctatcgctcgcgctacctggcggtaccacagttgatcccggtgctcgacctgttgttgctcgatgagcagaacccccatgcggtgctgttccagttgaaactggtgagccgcaccctgcgtcgcctcaatgatgatttcggtgtgccgcgggaaaccggcctggcgccgttggtggagcgcttggcgcgcttcgagttgggctgcctggagaacccgttgttcggcgaggccagcgtgcgtgctgcgctggacggcctggccgacctgttgcaaagggtcgccgatgaaagtgggcaagtgtccgatcgcctggcgctgcgccattttgcccatgtggacgatgtcagccagcagacggtgtcggtgtgatgagcgcgcgttatcagattttccacgatacccattaccactacgacagcccggtgtccctggcccagcaactggcgcatttatggccacgaccgtgtgcctggcaacgttgtacctggcaacagctggagatcagcccgcagccgtcttcgcgtcgcgatgagctggatgtgttcggcaacccgatcacccgcctggcgttcgaacggccccatgatgaattgctggtgaatgcggcgctgaccgtggaagtgctggcgcggcctgcgctggatttccagcaatcgccggcctgggaccagactcgcgacagcttgacctacagcagccagcccatggcagagcaactgatcgaagcctgtcgatatcgcttcgaatcgccctacgtgcatttgaagaaaaccttcgtcgagttctccgaaagctgcttcccgcccggcgagcccttgctgctgggcacacaggcgttgatgcagaagattttcagcgagttcactttcgatgccgaagccactcaggtcgccacgccgctggtggaggtgttggagcggcggcgaggggtgtgtcaggacttcgcccacttgatgctcgcctgcctgcgctcgcgcgggctggcggcacgctatatcagcggttacctgctgacccagccaccgcccggccagccacggttgatcggcgccgacgcgtcccatgcctgggtctcggtgttttgcccggagtcaggctgggtggattttgatccgacgaataatgtacagccggcactggagcacatcaccctggcctggggccgggatttctctgatgtgtcgccgttgcggggggtgattctggggggaggtagccatgacccggaggtgcgggtgacggtgatgccgttgtaggagcgagcttgctcgcgaagaacctgagggcgccgcggtgagtcaggcactccgcgttatcgttaacgcctttcgcgagcaagctcgctcctacagtaatgcttattccgccgggtctttcggggtttcggtctcgtcagtcgccacttcaccttccgcatccgggttcagtgcgcctgcttcttcgtctgcagcggctttcttgcgttgcagtttttcctctttcttctgttccttggccaagtctctctgacgtttggcgaaggagtaattaggtttggccatgggcgatcctctagggtcgaaggtgagggtgggcggcgcgcagctgccttgggtcgtcatggtagcagcttcaaggtgcctttcgccttcacttaccgcaggcgtaggcggccagcaggccgttgaacaggtgattgaggtgcatggcgcggactccagtgggcaatggagcgatcttaggcagcctgcggtactttggctggttgattgtgttgatcaagctgatagcctaaagttgtatacaatctgttgatgcagatcataagaacttaagcctgcttgaggcacccttgtcgcaatacgcgttttctaaccctgccttggagattcacatgtttgccaaactcgttgctgtttccctgctgactctggcgagcggccagttgcttgccgcagagtgcaaggtcaccgtcgactctaccgaccagatgtccttcaacaccaaagaaatcaccatcgacaagagctgcaagcagttcaccgttgagttgacacactccggcaacctgccgaagaacgtcatggggcataactgggtgctgaccactgaagccaacatgcagcctgtggctactgacggaatggctgcgggtatcgataaggattatctgaaggccggtgatgaccgcatcatcgcccacaccaagatcattggcgctggcgagaaagactcggtgaccttcgacgtctccaagctcaaggccgatgagaagtacaacttcttctgctcgttccctggccacatttcgatgatgaaaggtgccgtggtcctgaagtaacaccgcgttatcgttcatcgggggcgagccccctcccacattcgaccgcattctcatgctggaacgcggtcaagtgtgggaggtggcttgcccccgatggcattctggcaatcactgcaaaaccagctggctcacctcaaggcgcaaacggcatcacccgcttgtgctccgtcttgcggtacgtctcgcagataatcctgaacgcctcttcacgcacgggctcaccgtgcaggaacgcatcgatttcggcataggtcaccccgtgtgacgcttcgtccggcttacccggcgacaggtcttccaggtcggcggtcgggactttctccaccaacgattccggcgcgccaaagtgccgggcaatcgcacgcacctggttcttcaccagcccgctcaacggggccagatcgcaggcgccgtcaccgaacttggtgaaaaagcccatcaccgcttccgccgcgtgatcagtgccgatcactaagccgccggctgcgccggcgatggtgtactgcgccaccatgcgcatgcgcgccttggtgttgcccagtacgaagtcgcgggacaccgctgccttgccttcaaacgccgcgacttcattggccagggctttcactgccgggccgatattcacggtgtggcgttcgtccggctcgatgaattccaccgcggcctgggcgtcgtgttcgtcgaactgggtgtcgtagggcaggcgcacggcgataaaacgataagcctcgtcgccgctgctggcgcgcagctcctgcaccgcccgttgggccagcaggccggcggtcagggagtcgacgccgccgctgatgcccagcaccagggttttgagcccggaattgcgcaggcagtcctggataaaggctacgcgtcgggcgatctcggcttcaaggctggcctggtcgttgaacggcgcttggaccttgagctgctgcgcaatctcacgctgtacggcttgcatgattcactccttgctggaaagggcaggtactttgaaaacgtgacgcaaataggcgacaaaattcgggtcggtgcaatgggtcttgcccgcttcatcggagatcttggcgacgggctggccattgcaggcggtcattttaagcacgatgctcatcggttccacccctggaatatcgcaggtcaggttggtgccgatgccaaagctgacattaatgcggccacgcagcgcacggaaaatctccagggccttgggcagcgtcaggctgtcggagaacaccagagtcttgctcatcggttcgatgccaagcttgtggtagtgggcgatggctttttccgcccactggatggggtcgccggagtcgtggcgcaacccgtcgaacagcttggcaaagtacaaatcaaagtcgccgaggaaggcgtctgtggtaatgcagtcggtcagggcaatacccagcaggccacggtattcacgcacccagcaatcgagggcggcgatctggctgtcgatcaggcgcgggccgagttgctggtgggccatgatccattcgtgggccatggtgcccaggggcttcatatcgaactcgcgggccaggtgtacgttgctggtgccgacaaagcgcccggggaagtcgtgcttgagcacgctcactacttcttcctgcacacggtaagagaagcgccggcgcgtaccgaagtccgccacttgcagttccgagagctcgtcgctgctggcattcgccgtcagccaatcgaacttgcggtacagctgctcgcgcgcctgttcaaggatcacggtctggtagcggtagcggttacgcacttcgctgacgatggccagcatcggcacttcaaacaggatcacatgcagccacggccctcgcaggcggataaacaactcgccgttctcgataccggtctgtacgtagcgcaggttgaagcggaacagcccgagaaaacgcaggaagtccggcttcatgaagctgatacgttcaaggaaacccaactggtcggggctcaggctcagctcggccaggcgctcgatctggtagcggatctccgccaggtatgggcgcaggtcttcgctgttacggcagcggaactcccattcaacttccacgttggggtagttgtgcagcaccgcctgcatcatggtcagcttgtagaagtcggtgtcgagcaagttctgcacgatgcgatcggcaaacacactctcgctcataacgggaatctccagacgggtcggcgatgggcgccgacctttacgcacaattaaagaagggggctagtggcgcatagacgtgggtcggtttgccagtgatttttttgccagggccaccggcgccatcgagagcaagccccctcccacaggttgaaatgcgtttcaaatgtgggagggggcttgcccccgatggcggtattccaggcactaaataacctgctcaagcatccatttcacaaactccctgaccttcggcacctccgccgaatgctcaggataagccaggtaatatgcatcctggctcggcatcgcatgctgccaaggaatcaccagcttgccctcggccagttcctcctccaccagaaagcgcggcagcaacgccacgccacaacccacctgcgcggcgcggatgcacatatagaaggtgtcgaaacgcggcccgtggtagctgtgctcggtatgcatgccctggctggcaaaccagtcatgccagccctggggccgcgaggcgttttgcagcagcaccaggttgctcaattgcgtggggtcggtgaagggcagggcgggcaggctgtcgggcgcacagacaggtaccagctcttcgctgaacagcttcaaactctcggtgccggggcgcgaaccctggccgaagtagaaggccatgtcggccttgccttgcagcaactcgtcaggttcctgctcgttgcacaggtccaggtggatctgcgggtggcgcaggcgccaacccttgaggcgcggcaccagccagcgcgcgccgaaggtgtagggcgtggatacccgcagcacttcggtctcgccgccgtaggagcgcaggtaatgggtagacatctccacctgggtgaggatcttgcgcacttccaccaagtacagatcacccgccggggtcatctgcaagcggcgacgcactcggcgaaacagcaggtgttgcagcagctcttccaactgtgccacctgtttgctcaccgcgctttgcgtaaggttcagctcctcggctgcacgggtaaagctcaggtggcgggtggcggcttcgaaacactgcagggcggtgatcgacggcaaatgtcttctgttcagcacggcatgcctctttttattctttgcatgaataaacggaatgatatctcgcctaatcgtcgtttgttggcaagtcttgggccagctacaaataagcgctggatcgccgtgtcggtggcggcgcgaattttctgtttgagattgaaggagtgacccatggttgccgcattgcttgatcgtctcggggtaaacccggcgctgtaccaatcgggcaagcagcccgtgcattcgccgatcgatggtagccagatcggcagtgtgcactgggaaggcgccgccgaggtggagcaacaggtcagtcgcgccgagcatgcattcgaggcctggcgcaaggtgccggcgccgcgacgcggcgagctggtacgccagttcggcgacgtgctgcgccaatacaaggccgacctcggcgaactggtgtcatgggaagccggcaagattacccaggaaggcttgggcgaagtacaggagatgatcgacatctgcgacttcgccgtcggcctgtcgcgccagctgtatggcttgaccatcgcctccgagcgccccggccaccatatgcgtgaaacctggcacccgctgggcgtggtcggcgtaatcagcgccttcaactttccggtggccgtgtgggcgtggaataccaccctggctctggtgtgcggtaacgcggtgatctggaaaccctcggaaaagaccccgctcactgcactggcctgccaggcactgttcgagcgcgtgctgaaaaaattcgacggtgcccccgagtacctcagccaggtgatcattggcggtcgcgacgccggcgccgcgctggtggatgacccgcgcgtcgccctgatcagtgccaccggcagcacgcgcatgggccgcgaagtggcgccgaaagtcgccgcccgcttcgcccgcagcatcctcgagttgggcggcaacaacgccatgatcctcggcccgagcgccgacctggacatggccgtgcgcgccatcctgttcagcgccgtcggcactgccggccagcgctgcaccaccctgcgccgtctgattgcccatgagtcggtcaaggacgaaattgtcactcgcctcaaggccgcctacgccaaggtgcgcatcggccacccgctggaaggcaacctgatcggcccgctgatcgataagcagggcttcgacaacatgcaggatgcccttgagcaagccttgagcgaaggcggcaaggtgttcggcggcaagcgccagctgcaagaccaattccccaacgcctattacgtgtcaccggccatcgtggaaatgcccgagcagagcgacgtggtgtgtaccgagacgttcgcgccgattctctacgtggtcggctacaccgatttcgccgaagccttgcgcttgaacaacgccgtgccccagggcttgtcgtcatgcatcttcaccaccgatgtgcgcgaagccgagcaattcatgtcggccgtgggcagcgattgcggcattgccaacgtcaacatcggcccgagcggcgcggagattggtggcgcgtttggcggtgagaaagagaccggcggcggccgcgagtcggggtcggatgcatggcgcgggtatatgcgccggcagaccaataccgtgaactactcgctggagctgccgttggcgcagggcatcacattcgactaagtcctcaagtcgaagtgaggtcaaaatgtgggagggggcttgctcccgattgcggtggatcagttgtatatctgctgactgacacgccgccatcgggagcaagccccctcccacatttgattgggttcataacttaaaaaactagctgtttgttaggtcctctacggagtctggcaatgtctttacgcgaaacatgcttatgggaacaactcacccccagccgaccggatcgcgccgcgctcaagggcgcggtcaaggtggatgtatgcgtgatcggcgccggcatcaccggcttgtcggccgctattcacttgctggaacagggcaaaagcgttgccgtgcttgaagcacatcgcaccggccatggtggctcggggcgcaacgtcgggctggtgaatgccggcatgtggatcccaccggacgagatcgaagccggtttcgggacggcggtgggcagccagctcaatcgcatgttgggcgcggcgccgtccctggtgttcggcctggtcgacaagtaccgcatcgattgccaattgcgccgcgagggcactttgcacatggcccacaatgcccgtggcgaggcggatttgcgcagccgtgaagagcagtggaaacgccgtggtgcgccggttgagttactgaccgggcaagcatgcgagcaagccaccgggaccaagaaaatcgctgccgcgttgctggatcggcgcgccggcaccttgaaccccatggcttacacgacgggcttggcgaatgccgccgtggggctgggcgggcagctgtttgaccattcaccggtcacccagctggagcgccaaggtgccgattggtcagtgcagaccgccgagggcgcggtgcaggccgcacaggtggtgatcgcctccaacgcctacaccgagggcgaatggaccgagttgcggcgcaatttcttccccggctattactaccaagtggcgtcgacgccgttgaccgacgatgccgcccagcagatcctccccggcggccagggctcatgggacacgcgccaggtactgagtagcatccgtcgtgatgccgatggccgcctgttgcttggcagcctgggcaatggcaaccagaaaccagcctggttcctcaaggcgtgggctgatcgggtgcagcagcactacttcccctacctcaaatcggtgcagtgggaatgcacctggaccggttgcatcgccttcacgccagaccatctgatgcgcctgttcgagccggcgccagggctggtggcggtcaccggctataacggccgtggcgtgaccaccggcagcgtggtgggcaaggcgtttgccgactatctgtgtcaccaggatccccaggccctgccgatcccgtttgcgcccatgcaacccttgaccggggcaagcctgcgcagctgcttgtatgaagctggattctcgctgtatcacgccggacaatgcctgaggatcgtgatctgatcagcgaaataccgctcaaaagcctgcgttttcttagcaggctacccatctgtattggtgcaaggcgtagcaatcacgcactgtaaatgtgcagttccgttacgcacgttgttacagctgtaggaactgtcgtttatccctctggttgcagctgcgacctggcagggttgtacttttttggctcgttggttgcacctatcggtgctagacggttgcacgtcctggcaaaaggcgtcgaaacgcctgtaataacaatgacaccgtgtctttttgaagaataaaaacgtaatggcacgcggcttgctctgagctttcggtgaaaggtttgaatgcaagttgtcgtgccaaaaatcaaaaatatcggagcaccactcatgtcccagacgttttacaagaaaggttttctggccctcgccgttgcagcggcgctgggtgtttctacgtttgttcaagccgatgtgaagattggtgtggcgggcccgatgacgggcgccaacgccgctttcggtgagcagtacatgaagggtgcccaggcggcagccgacgttatcaacaaggccggcggcatcaacggcgagcagatcaagctgattgccggcgatgacgcctgtgaacccaagcaagccgtggccgttgccaaccgcctcgcggaccaggacaaagtcatcggcgtggtcggacacttctgctcctcgaacactattccggcatctgaggtctacgacgaagccggcatcatcgccatcaccccgggctccaccaacccccaagtcaccgagcgcggcttgagtgcgatgttccgcatgtgcgggcgtgacgaccagcaaggcatcgtcgccggcgactacatcgtcgacgtgctcaagggcaagaaagtcgcggtgatcaacgacaaggacacctacggcaagggcctggccgacgctaccgctgcgcagttgaccaagcgtggcgtcaagccggtgctggaagagggcctgacccgtggcgagaaagacttcagcgccctggtcaccaagatccgttcccttggcgccgacgtggtgtacttcggcggcttgcatccggaagccggtccgttggtgcgccagatccgtgaagccggtttgaaagacgtcaagttcatgtccgatgacggcgtggtgaccgatgaactggtggcgactgccggtggtgcgcagtacgtcgatggcgtgtacatgaccttcggcgccgatccgcgcctgctgccggacagcaagaccgtggtggaagaattccgcaaaaacggcaccgagcccgaaggctacacgctgtacgcctacgcctcgatccaggccctggctgccggcttcaacggtgccaagtccaacaagggcgaagacgctgccaagtggctcaaggccaacccggttaaaaccgtcatgggcgaaaaagcctgggatgccaagggcgacctgaaagtctctgactacgtggtttaccagtgggacaaggacggcaaataccatcagttggaaaagcagaagtaagcctgagcaccacagtgccaatgtgggagggggcttgctcccgatagcgcagtgtcagccaatacatgcatgactgacccaccgcaatcgggagcaagccccctcccacaggagagtggcgttgttattgagatctgttttttcctccagaagcgccgcacacccactggtgtgcaggtgctcaccgcgtgagattgcgttatggatggtattttcctgcagcaactggtcaacggcctgaccctcgggtcggtctatggcctgatcgccatcggctacacaatggtctatggcatcattggcatgatcaacttcgcccacggcgaggtttatatgatttccgcttacctcgcggcgatcagtctggcactgctggcttactttggcatcgaatccttcccgctgctcattctcggcaccttgatcttcaccgtggtcgtcaccggcgtttatggttgggtgattgagcgtgtcgcctataagccgctgcgtaactccactcgactggccccgctgatcagcgccatcggtatctcactgatcttgcagaactacgcccagatcgcccagggcgccaagcaacaaggcatcccgaccctgctggccggcgcctggcgcgtcgatatcggcactggcttcgtgcaactgacctacaccaaagtgttcattctcgtggcggcgttcgccggcatggcattgctcacctacatcatcaaatacaccaagctgggccgcatgtgccgcgccacccagcaagaccgcaagatggcctcgatcctgggcatcaacaccgaccgggtgatctcctacgtgttcgtcatcggcgcggccatggccgccctggccggcgtgctcatcaccctcaactacggcaccttcgacttctatgccggcttcatcatcggcatcaaggcatttaccgcagcggtactcggcggcatcggctccctgcctggggcgatgctcggcgggatcatcctcggtatctctgagtcgctgttctcggggttgatcaactctgactacaaagacgtgttcagtttctccctgctggtggtgattctgattttccgtccccagggcctgcttggtcgcccacttgtggcgaaggtgtaaacatgtctgctgccaaatccattgatatcaagaaaagtgtggtcgatacggtcctcgccgggctgatttcgctgatcgtgttcggccccatcgtcggcgtggtgctcgacggctacagcttcaacctggagccgatgcgcgttgccacattggtcgccattgtgatggccggacgttttgccttaagcctgttcctgcaaacccccaagggtgtgaagattctgcagggcttcgaaagcagcggctcgggtgtgcacgtgctgccaccggactacaagtcgcggttgcgctggatcatcccggcgttgatcgtgatcgccatcgtgttcccgatcttcgccaacaaatacctgctcaccgtggttatcctcggactgatctacgtgttgctcggcctggggctgaacattgtggtgggcctggccggcttgctcgacctgggctacgtggcgttctacgccatcggtgcctatggcttggcgctgggttatcaatacctcggcctgggcttctggacggtgctgccattggcggccattgcggcggcattggcggggtgcatactcggcttcccggtgctacgaatgcacggtgactacctggccatcgtgactctgggttttggtgaaatcattcgcctggtgctcaacaactggctgtcgttcaccggcggccccaacggtatgccagtaccttccccaaccttcctgggcctggaattcggcaagcgggcgaaggatggcggcgtcccgttccacgagttctttggcatcgattacaaccccaacatcaagttcatgttcatctacattgtgctgtttctggtggtgctggcggtgctgtacatcaagcatcgcctgacccgcatgccggtgggccgcgcctgggaagccttgcgcgaagatgaaatcgcctgccgctccatgggcctgaaccatgtgctggtcaagctctcggcgttcaccatcggcgcatccaccgccgggttggccggggtgttttttgccagctaccagggcttcgtcaacccgtcgtcgtttaccttcttcgagtcggcattgatcctcgccattgtggtgctaggcggcatgggctcgacggtgggagtggtgatcgcggcgttcgtactgactgttgcgcctgaactgctgcgcagtttctccgagtaccgcgtcctgctgtttggcgtgctgatggtggtgatgatgatctggcgaccccgtggcttgattcgaatcagccgtaccggtgtgacgccacgtaagggggtagcaccatgagtaaggaagttgtgctgtccgtggaacacctgatgatgcacttcggtggcatcaaggccttgagcgatgtgagcctcaaggtcgaacgcaactcgatcttcgctctgatcggccccaacggcgccggcaagaccacggtgttcaactgcctcaccggcttctacaaggccagcggcggcaagatcgaactcaatgtgcgaggccagcagaccaacgtgatccagttgctcggcgagcgcttcaaggcggtggacttcgtgtcgccgaaaagcttcctcagccgcgtgtactacaagatgttcggcggcacccacctggtaaaccgcgccggcctggcacggaccttccagaacattcgcctgttcaaggaaatgtcggtgctggaaaatctgctggtggcccaacacatgtgggtcaaccgcaatatgctggccggcatcctcaacaccaagggctaccgcaaggccgaaagcgatgccctcgaccatgccttctattggctggaagtggtcgacctggtggactgtgccaaccgcctggccggcgagctctcctacggccagcagcgccgcctggaaattgctcgcgccatgtgcacgcggccgcagatcatctgcctggacgaacccgctgcgggtctcaatccccaggaaaccgaagccctcagcgcgatgattcgcctgctgcgcgacgaacacgacctcacggtggtgctgatcgaacacgacatgggcatggtgatgagtatttccgaccacatcgtggtactggaccacggcaacgttatcgccgaaggcggcccggaggcgatccgcaacgacccgaaagtgattgccgcctacctgggcgcggacgaagaggagctggtatgagtgcgcctatcctcgaaatgaaggatctggacgtgtattacggcccgatccaggccctgaaaaaagtctcgctgtacatcaacgaaggcgaaaccgtcagcctgatcggctccaacggcgcgggtaaatccacgctgctgatgtcgatctttggccagccacgggccgagtcggggcagatcctctacaacggcgtcgatattacccacaagtcgtcccactacatcgcttccaacggcattgcgcagtcgccggaagggcggcgggtgttccccgacatgaccgtcgaggaaaacctgctgatgggcaccatccccattggcgacaagtttgccggcgaggacatgcaacgcatgttcgagctgttcccacgcctcaaggagcggcgcaaccagcgggccatgaccatgtctggcggcgaacagcaaatgctcgccatcgcccgtgcattgatgagtaggcccaagctgttgctgctggatgagccgagcctgggattggcgccgattgtagtgaagcagatcttctcaaccctgcgtgaactggcctccaccgggatgaccatcttcctggtggagcagaacgccaaccatgcgctgcgcttgtcggatcgggcgtatgtgatggtcaatggtgagattcgcctcacgggcaccggtaaagagctgctggtgaatgaggaagttcgcaacgcttacctaggcggtcactaactgttactcagtaccctgtgggagggggcttgctcccgatagcggtgtgtcagtttaagaagtgctgactgacaaatcgctatcgggagcaagccccctcccacatttgattgtggggtccataaggcctttctccaaattgtggaaaacaaatccagccaccctccaaagcgcgacatatagccgccgcaaatccctgttttgtcacagttttgacttgtccccatccactgtggaaccggctgtgggtaacgtgggagtagctggctgaaagcctttaaacacgtggcttacagcctcgtggttgttttttgatcagtcggttttttgcggccgtccgagggttttgtcaacctgtttaaagacacaggtatatgaccggaatgtgaccgtccagcctgtggataagtctgtgactaaactctggaaagacccccgaaggggccggaatgactggcctggagccatcgttatgctttgccgcatatgtcagcggctacatacgcttgcatccaggtcaagcaaaaaactttccagacccgcctgaaagccttgtatacagcggcttcaagcagtttgcacttgcccccaaagactgtgggcgcagttgtggataacctgcgcgcatatggctgcaagccacggtttataaggctctgctcaatgtggttacaaaatgatcagtcatgcatgaaggtgtgtgcatagcggttgccgcaagggcggcgtaagggcattctgctggctgcttttttccccgatgcccgcaaggagaacaccatgtccgacacgctatttatcactggcgccacttcaggtttcggcgaagcctgtgctcgtcgttttgccgaagccggctggaaactggtgctcaccggtcgccgtgccgagcgcttgagtgcgctggttgaagagctttccaagcagaccgaagtgcatggctttgtggtagatgtgcgtgaccgcaagggcatggaagacgccattgccaacctgccaccgtcgttcgccaagctgcgcgggctgatcaacaacgccggcctggccgtgggtaccgaccctgcgcccaagtgcaacctcgacgattgggaaaccatggtcgacaccaatatcaaaggcctgctgaccactaccaatctgttgctgccgcgcctgatcgcccatggtcgcggcgccgggatcatcaacctgggttctatcgccggcaactatccttacccgggcagccacgtatatggcggctccaaggcgttcgtgaaacagttctcgctgaacctgcgttgcgacctgcaaggcaccggtgtacgcgtaaccaacatcgagccggggctgtgtgagagcgagttctccctggtacggtttggcggtgaccaagcgcgttatgacgccacctatgcaggtgccgagccgattcagccgcaggatattgccgatacgattttctgggtgatgaatacgccggcgcacgtgaatatcaaccgcttggagctgatgccggtgagccagacctgggctgggtttgcgattgagcgtgggactaagtaaggctttagaccgcgtcgctgccatcgggggcaagccccctcccacattggatcgagttcatagatcttgatttgttaacccattcaagtgtgggagggggcttgcccccgatggcgtcaaatcggccaaaacaggacataaggtacactccgctcctgaaagccctccgcactgtgcggtttaaaggttttgacaggaggaaatgtgagtaaccgaggtgagcaggcactgctcaaacaatcgacgatcctgatgttcgctgtagcgatcgccgggattgtcacgggcgtgatatccggcgcccaatccattctgttcgacggctttttctcgctgatcgccaccgccatcaaggtgctgatgctgatcacggccaagctgatcgccaagaaaagcaacgagcgtttccagttcggctattggcacctggagccgatggtgctgttgatcgaaggcagtttcctgctgttgatcgccatctacgcgttcctcaatggtgtgttcggcattatcaatggcgggcgcgagatcgagttggggttggtgatcgtttatgcggcggtgtttaccgtcgtggagttcgcctacttcttctatgtgcgctaccgcaaccgcaggctcaaatcatcgctgatccagttcgacaacatcagttggctggtagacgcgatgctctcggtgggcttgctgatcagcttccttgccgcgctgttgctcaagtcccagggttatggcgagtgggcggtgtatgtcgacccgttgatcctgatcctgctggccctgagtatgctggcgccagcattcaagatcctgcgcccggcgttgcgcgaggtattgggaatcgccccggaccatctggacgacaaagtgcgcgaagtaatggacgcggcgcaggccaagcacggtttcgacgattacgtgtcctacgtgcagaagcacgggcgggcgcggtttatcgagattcatgtggtattgccggcggattacccggtggataaggttgcgacgttggatgggctgcgcgaagagatatccacagggctgggcacgccggatgcggcgcgttggctgacgatcagttttacgggcgaccgcaagtggattgcgtgaggtcagtcagaccgagttgaggccatgggagcaagccccctcccacattagaccgagttcccacatgaaaacgcggacaaaggtgggagggggcttgccccccgatgaggccctgaagatcacccaagctgcttgatcaaaccctggtagcaggtcgccaagtgatacggcgtagtcgacggcatatcccgtcggctcacggagccctgggcatccaggcattcatgccagcccttggcatgcagaaaatgctcttgcagcgccagcaattggcgctgcagcgccgcctcactgcctggtcgtaacgtcagcgcacgcaagtactcggcctgagcccagatacgttgggtgccgtcgcgcaccgtgccatccagcgcaagcatgccactgaccgcaccgctcgatttatccacacccatttcttcggcataggcaaacgcccgtgtcagtgacgcatgcagcggtgtgccgcgcagcacctctgacgattccagcaaaaagaaccattcgaactggtgccctggctcaaaccagttatccacagcccccaacggtttttccatcatcacgccatgctcgcggtcgatgaagcgttgctgcatggccgtcgccaacgccagcagggccgcctggacgtcggcatcctcacgcactgcgagagtcgcaaggaagccttcggccaggtgcattaacgggttctgcaatggccctgaacccagcgaggcccagttacgctccagcactgcctcatacaggccatcgcccgtggcaaagcgctgggcgacgacttccaaggcggcattgagcaccgattccaccagcggttcacgcaccttggcccagtaatgggcgcaggcaaagatgatgaaggcatgggtgtagaggtctttgcgtttgtcctgcggttggccggcggggtcgatgctgtagaaccagccaccgtgctcggcatcgtggaagtgccgttgcagggagcggaacagcgccgctgcacgctcttcggcaaaggccgcgccgggctcaccgatcaggttggcgaacaggtacaactgccgggcacaggccatggcgcggtagcgttgcgggggcagcggctggtgatcggcgtccagcgcctcgaagggcagtgccaggtcggcattccagcctgggccttgccagaggggcacgatcaggtcgtggaagtgcgtgagcacggtgttcagggaagggggggaagcaatgggcattggctggcgtcgtcacggcaggggtgtaggcgcgcatggtagcaggcttggcaactgtggtgtctgcaccagcgctatcgggggcttgcccccgatggcgccttcagccgcgccgcaaatcaccccgccaacaaccaaaccccagttgccgccgaagccgccccggccactcgcaccaagggcgccgccgcaaccggcagaaagcgcaccaccgcataacctgcggcatgcaacaccgcagtcgcccccacaaacccagcggcatacgcccaagggctggtcatgtccggcaattccaaaccatgggctacaccatggaacaacgcaaacaacgccgtggcacccacggccacaaaaagcggcggccgcactgccaacgctacagccaggcccaacgccagcaccgacgccgcaatcccgctctccagcgccggcaattgcagcccttcaaaacccagcacgccgccaatcaacatggtgccaacgaaagcacaaggcagcgcccagcgtgcgttgcctttttgctgcgccgcccatagaccgaccgctaccatggccagcaagtgatcgaggccacccaacgggtggctgatgccggccaccaggccattgtcgccgtggcccggatgggcgaaggccagggcagggacgagcagcagcgcggccgcggcgaagagtttgttgaggctcatggacaggttccttataggttgatcaggcggcggtcagcaggccctggcgttcgataaaggcgacgatttcttccaggccgaccccggttttctggttgctgaacacaaagggcttaccgttgcgcatgcgctgggtgtcgctgttcatcaattccagcgaggcgcccaccagcggggccaggtcgatcttgttgatcaccagcaagtcggatttgcaaattccgggcccgcccttgcgtggcagcttgtcgccggcggacacatcgatcacatagatggtcaggtccgacagttccgggctgaaagtggccgacaggttgtcaccgccggactccaccaggatcaggtccaggcccgggaagcggcggttgagctggtcgacggcctccaggttgatcgaggcgtcttcgcgaatcgccgtgtgcgggcaaccaccggtttccacgccgatgatgcgctcgggcgccagggcctggttgcgcaccaggaagtcggcgtcttcgcgggtgtagatgtcgttggtgaccaccgccaggttgtagcgatcacgcagggccaggcacagggccagggtcagggcggtcttgccggagcccaccgggccgccgatgccgacgcgcaggggttgggtgttcatatctgattctccaaaaaaaactaggaacggaacaggcggctgtattggcgctcgtgggccatgcacgccagggacaggccaaaggcggcgctgcccaaatgcttggggtcgatgcgctcggcgttttgctgggcttgttgcagcagcggcaacagttcgctggtcaggcgttgtgcggcttgctggccgaggggcagggttttcatcaacaccgccagttggttttccagccagctccacagccaggcggcgagggcgtcctcggggctgatattccaggcgcgggcggcgagggcccagccgagggccaggtgcggttcgtcgcgttgtgcaaggaactcacgggcggcgctgtccagttccggcaagccgttgagcagttgttgcaaggaatagcccatttgccggctctcctgataaagctcgcgggtctcgcggctggcacggtgttcttcacacagctgcgccagcctcgcccattcctgatcgacagccgcgcggcagtgagcgagcagcagtggcgcttcgaaacgtgccaggttgagcagcaattggtcgctgatccagcgccgggcactcgcggcgtcctgtacgcggccattgtccacggccatttccaggccttgggaatagctgtagccgccaatcggcaattgcggactggccaggcgcaacagcgcccaggctgggttcatgcgcgcacgccgaactggtgcagcttgggcgcgtagttgaagtcttcgtcgccatgccgcgaatgatgatggccaccgccgtacgcaccatgttccggctggaacggcgcttcgatggtctgcgcgtcggcacccagctgttcaagcatggccttgagcacgtagtcatcgagcagacgcagccagccgtcgccgacttgcagggccacatggcggttacccaggtggtaggccgcacgggtcagttcaaacgcgttgcggcaagtgacgtgcagcagctgttcaggtctggcgcgaacgcgtacgacacgtccgtcttcggcttgtaggaattcgccatcgtgcagcggcggctgaccacgctccagaaacaggccgacgtcttcaccctcggcactgaaacagcgcaggcggcttttgctgcgggcttcgaagttcagcagcaactcggcggcccagagggcttgcggggcgattcggcggtgtatcaccagcatcaggaggcttccagctatgagcgatggatgagctagagcaaggggcttgccaatccgcagattgagtaggaattccctgtaggtaggcatgggcatgctgcccaatagggcgtcagggagttctccaagtgtatcgatttggtgcgtgacgggatttatagcaccggtgaggggcgttttacgtttaagtcggtgcggactttgatgaagtttctttcatcattttcttgttggtgttttttcggatttgtcctacgcgttatcaggatttggagttcatgacattactcgcggcttatttaggctgtgcgccgtgtttaattccaccgcgacgttcatcatgtttagatcaattttattcgtatgccttgccagtctgacctttgtcatttcatcggcctcggccagtcttcaaccacgcgctactctcggtacttccctgcaggccatcaagcctgcgtccatcgacggcgtgatcgatcgcgcccatgagttgttgggcacgccttataaatggggcggcacgtcggcggaacaaggcttcgattgcagcagcttcctggtgtatctgttcaagaccgaagccaatgtgctgataccccgcactaccgcggccatgcaccggtcctcggcggcgactatcaagcgcaatgccttgaagcctggggatgcagtatttttcaaaggcaacgggcgtggccaggtcagccatgtcggcctgtatattggtgaaggcaaattcatccattcgccgcgcaccggcaaaaagatccgtatcgattcactgagcaacagctattggaataaaaactacaccactgccaagcgcttccacacggcgggctgaccggcttattcggtgctgcccagcccctgccaatgcttgaggccgataaagataaagcgaagttgctgggttattttcgcctggggcgtgaggtggggcggcagggcatgggccggtgggtcgatgatgtcgggcagggtggcgaacacacttttgacgatcaggtcggccattacatgcaaaccctctgggtccaggtgctgcaacttcggcatcagcgtcaggtcggccgccaggtcgcgggtgatgtcttcgcgcagggccgcgatggcttggcgtaccgccaggcaaccgccgtactgttcacgggccaggaacaggaattgtgagcggttggccgagaccacatcgagaaagatccgtacggaggcatcgataatgccacccatcacgaactcgttatggcgcaccaggcgaatcgtggcgcggaaggtctggccgacttcactgaccaacaccagccccaactggtccatgtcggcaaaatggcgatagaaaccggtaggcacgataccggcggtcttggccacttcgcgcaggctcaggctgccaaacccacggccacactccatcagatggcgggctgcgtccatcaaggcgaggcgggtctgttgcttctgttcggcacggggcagcatgagcgaatgggctttgtcggcgagtacagcgacgcactctagcaaaagcgctttgccggcgtcgaacttggcgggggcgaggcgtgacgcggtctatataaaagcaaaagcccgatcggcggatcgggcttttttctgggccaccacgggcttagctctgtgcttgatgcagttcttgcagacggtcggcaccgccttcagcaacaccttcggtgtaggcgcgtttgttggcttgttcagcaccgccttctaccaagcctttttcttgcagacggttatagccattttcagccacggcacctttggcatagtcgcggttttcgtcttcttgcgaaccgctgcgggccacggtctggctggtttgcacggattgggctttattttgtggggtggcctgttcggcagctggcagggcaaaagcgctggaagccaggacagataacaggacggtagcgagtaattggcgtttcatggtggttgctcctcggaagggcgttaaagtgggtacagggctaatgctactcttgataagtcgatataaaagttcataaacacaatggtaataatcaacagaattgattgttccctgcggaggctctagatcgagcctctcaagcacgcggttttgcaccgaggtgggtattttcgacacgaacatgggtaacaatggtgcgccagtgatgatcgaaatctgtctgttcgatcaggaaagtggctttttgcgactaaattacgcgtcgggttaaacccccgggcggtttgccagtcgtagtcttataggctgctctagaggggtagctctgccagtcgtattcaggagtcctgtgcaatgacgcgcactcgtaaaatcgtcgcttggagctgcgccagcttcgttctgttaattgccatcgtggtgctgatcctggtgttcttcgactggaatcgcatcaaaccgccactcaatgccaaggtctccgaagaactgcatcgcccgttcgctatcaacggcaacctcgcggtggtgtggcagcgtgagcccgatgaaggcggctggcgcgcctgggtgccgtggccccatgtgattgccgaagacttgaccctgggcaaccccgactggtcgaaacaaccgcagatggtcacgctcaagaaggtcgagctgcgtatttcgccccttgccttgctggtgcagcgcgtggtgatcccgcgcatcgacctcaccgaaccgagtgcccagttgcagcgcctggccgacggccgcgccaactggaccttcaagttcgatccgaaggaccccgacgccgaaccctccaattgggtggtggacattggctccatcggcttcgacaagggccatgtgaccctcgacgatcaaaccctcaagacccagctcgatgtgatcatcgatccattgggaaaaccgatcccgttcggcgaaatcgtcggcgatgccgatgcgaagaaggccttggaaaaaggctcggcaccccaggactacgcgttcggcctcaaggtcaaaggccaataccacggccagcagctcgccggtaccggcaagatcggcggccttctggctttgcaggacgcggccaaaccgttccctctgcaagcccaggtgaaagtcgccgacaccagcatcgccctggccggcaccctgaccgacccgctgaacctcggcgccctggacctgcgcctgaaactctcgggcagcagcctgggcaacctgtacccgctgaccggcgtcacgctgccggactcgccggcctactccaccgatggccacctgatcgccaagctgcatgaagccagcggcgcctcattccgctacgaaaaattcaatggcaagatcggcaacagcgatatccacggcgacctggcctatgtcgccagccagccgcggcccaagctcagcggcgcgctggtgtccaaccagttactcatggatgacctggcgcccttgatcggcgctgattccaatgccaagcaaaaggctcgaggcggggagagcaagcaaccggcgaccaaggtgttgccggtggaagagttccgcaccgagcgctggagtgccatggatgccgatgtggagttcaccggcaagcgcatcgtgcacagcgccgacctgcccttcaccgacctctatacgcacctggtgctcaacgacggccaactgagcctcgaaccgctgcgcttcggcgtggccggtggcaagctcgatgcgcagattcgcttgaacggccgcaccacgccgatggaaggccgcgccaagttgacggcgcgtaacttcaagctcaagcagttgttcccgaccttcgaaccgatgaaaaccagcttcggtgaactcaacggcgacgccgatatatccggacgtggtaattccgtggccgcgctgctgggcacctcaaacggtgacctgaagatgctgatcaacgacggcgccatcagccgaggcctgatggaaatcgccgggctcaatgtgggcaactacgtggtgggccgcctgttcggcgacaaggaagtgaagatcaactgcgcggcggcggacttcggcatcaagacggggttggcgaccacgcggttgtttgtgttcgataccgagaacgccatcatctacatcgatggcaccgcgaacatggccacggagcagttggacctgaccatcacgccggagtccaagggctttcgcttgttttcgctgcgctcgccgctgtacgtcaatgggccgtttatcaagcccaatgctggcgtgaaagccattcccctggccctgcgcggcgccggcatggtggccctgggcgttattgccggcccggctgccgggttgctggcgctggtggcaccgagcggcgatgagccgaatcagtgcgcaccactgctgcaacagatgaaagagggcaaagcgccgaaaaccgtgaaataactgactacacctgaaaccaaatgtgggagggggctcgcccccgatagcagcggttcagtcaatatctaattcgactgacactccgctatcgggagcaagccccctcccacagggggactgctgtgttgctgattacaggtcctgcagaatatccgccatgtcatcggcgtgttcttcttcctgggccaggatgtcttcgaagatacggcgggtggtcggatccttatcaccgatgtactggatgatttcacggtagctgtccaccgcgatacgctcggccaccaggtcctcgtagaccatctctttgagcgagttgcctgccacgtattgggcgtgggagttcttcgacagcaggtcggggttgaactccggctcgccgcccagttgcacaatgcgctcggccagtttatcggcgtgctcggcttcctgggtggcatgttcgaggaactcatcggcggcgacgctggctttcaggccgctggccatgaagtagtgacgcttgtagcgcaacacgcagaccagctcagtggccagcgactcgttgagcaggcggatgatctcctgacggtcggcgtcgtagccttcggtcacggcaccgttttcgacattctggcgggcgcggctgcgcagggtcgcaatgtcagtcaagtgtgcttcagtcatttcaatctcctggggctaatccggttgtacgccacgctctgccggcgtgatcgctataggttgtgagtcccgggccaggcgaaaagttttatcggatttaacaggatgtgtcatgagtggctctgaccggcgtgatccagcgctccgagaggatcaccccacccaaggtcagcaagccgcccaccaagtgatacggcgctaactcttccttgaggactaccgctgcaatcagtgcggtaatcaacggcagtagattgaagaacagcgtggtacggctcggcccaagcgtcttcaccgagtgcatccacgccagcggcgccagcatcgaggccagcaggcaggcgtacagcaccagcggaatattcgcccagcccaggcccgccttggccgagaacagatacagcgggaacagcaccaccaccgccaccagcacctgtagatacaagagcaccaacggtggcaggcgcaactgccattttttcagcagggtgctgtagaccgcgtaggccagtgtggcgacgagcatcatgccgtcgcccaggttgaccccgtgttgcagcagcgcaccgaggctaccggacgacaccaccaccactacgccggcgaatgacagcactgcgccggtcagcgcgccataggtcaggcgttggcccaggctgataatggcggcagtcagggccatcagcggcatcagcgacaggatgatgcccatattggtggcgctggtcagcgtggccgcgtaataggccaggctttgatacaccgccatgcccagcacgccgaggatgaagatcttgcccaggttcggacggatgagcgcccagttggcaacgaccggcttgagcatgaatggggtgaacagcagcgcggcgaacagccagcggtaaaagccgatttcagccgggaagatcgagcccacggccaatttgttgaccacggtgttgccggcccagataaggatggccagcagcggatacgcgtattgcatcgaaataatccagtgtgttgacgaggcgggattatcccctgtctggatcgaagcctatactgcgaaccagacaaccgacctctgaatccagacaacatgcccagacataccgtacgcctcgcggatttcgccagcctgcccagccctgtgtacttccgctactccgagttcgccccggataccgagtgcaccccgcaccggcatggctggggctcgctggactattcggccaatggcgtgatgcgcatggaggtcgccggcaaccgttttatgtcgccaccgcagtacgcggtatggatcccaccggataccgagcacagctcctataacgcccaggcgatcgtgtatcgctcggtgggcttggcgccgacgctctgcgagcaactgccgcaaaccccatgcaccctggcgatcagcgacattctcaaggctatcctcagcgattttgcccagcgtgacgtgaatatcccgcaaacggacgccgatattcgcctggcccaggtgctggtggaccagctcaaacaggcgccgattcacgacggcttcttgccctacgctcgccacccagggctgctcggtgtcctggaaggcatgcaagcgcaaccgagcgacaatcgcccgctggtgcaatgggcggagcaagtgcatgtcagcgagcgcaccctggcgcgccagtttgtgcgcgaactgggcatgagctttggcgaatggcgccagcgcttgcgctacctggcggccattgaagcgctggacagtgaacgcagcgtgcagcatgtggcgtttgatttgggttacagcaccgcctcggcgtttatcgccatgttccagcgtcacgccggttgcacgccggagcagtaccggcgttcgaacatacgtggtcgctgaagttgtaacaggttttgactacactggcaggtaggccgtgcccgtcggcacggtaacagggagaaaactccatgaagatgctgcgtattccgttgttgatgatgggcctgctgctgtgttcccagggctttgccgctaccgcccagcagaacaaaatgaccacctgcaatgccgaggccaccaccaagacgcttaaaggcgatgagcgcaaggccttcatgaagacctgcctgtccgcccctgccgccaacgacgccaagaccctgacgccgcagcagcagaagatgaaagattgtaatgcgtcggctaaaaccaaagcgttgaccggcgatgcgcgtaaaacattcatgagcacctgcctcaaaggttaatcacgatttcgcaggcgccgcaaaacaaatgtgggagggggcttgctcccgatagcggcaggtcagctacagataagttgactgacataatgcaatcgggggcaagccccctcccacactgatcgcattcgcaaccaacctcctcgcttgattgccgcaaggctggcagactgcccatcctttaacgccgttcgttttgaggctgtatgccaacgttttctcagcgtcatgtgttgttgctgtccagctacatcatcattttcggcgggttgctgctggtgctgccgctcaaattgctgcccagcctgctggccggcctgttggtctatgaactggtcaacatgctcaccccgcaactgcaacgcctgatcgaaggccggcgtgcgcgctggctggcggtggccttgctgggcaccctgatcgtcagcgtgctgaccctgatcttcgccggcgccatcagcttcctgctccacgaagcggaaaaccccggggcgtccctcgacaaattcatgggcgtggtcgaccgcgcacgcggccaattgccgccgtttatcgacgcctacctgcccgccagcgccgccgagttccgcgtcgccatcggcgattggctgagcaagcacctgagcgaactgcagttggtgggcaaagacgctgcgcacatgttcgtcaccttgctgatcggcatggtcctcggcgccatcatcgcgctgcagcgcgtgccggacctgaccaaacgcaaacccttggccgccgcgttgttcgaccgcctgcacctgctggtccaggcgtttcgcaacatcgtcttcgcccagatcaagatcgctgcgctcaataccgctttcactgcgatcttcctcgcggtggtgctgccgttgtgcggcatccacttgccgttgaccaagaccctgatcgtgctgaccttcctgctcggcctgttgccggtgatcggcaacctgatgtccaacaccctgataaccatcgtcgcgctgtcgctgtcgatctgggtggcggtggcggcgttggggtatctgatcgtgatccacaaggtcgagtacttcctcaacgcacgcatcgttggcgggcagatcagtgccaagtcgtgggagttgttgttggcgatgctggtgtttgaggcggcgtttggtttgccgggagtggtggcggggccgatttattatgcgtacttgaagagtgagttgaagttgggggggatggtttgaccatcttcaggcagggcgactgaaaagccgccccgttctagcttacgacgcttgcggacttagtctgcgtccaattacatccatcagatcacacccatcccgcaagggaatggccagcagttgtgcaaagtcgtggagcaccacggcatcgctgctgatttcttctcggaatgcgagattttcaagtaattgcgtcactgcgcgaatgcggtacgcggcggcttcgtgtaggacgtcgagaggtgcctgtgtatcgatgattagagcggggatggtgcagtcgttgccagtcaaagggatgtagcgattcataagtgaaactccgtggactaataagaaggagctcccactcgattgtcgccaaacaattgggtggcagctgtacgcaggttggcgaaccggtccacgggcccggcagacccaaaggtctcccgcgcacagccgccataatgcggctttgcgggtacaaaaatgcctgccaacgaagcaggcatttttgaacgtggatgcaggtcgccaaacctgatcgccatgagggcgacggccggactataagcgtcatcacgcaaatcgtgcaaggttggttacaacattcatccggtagggcggtggtgcacaaggtattgagtgcgcgcaggccaacatgtgggagggggcttgctcccgattgcggtatggcagtcagcttatctgtagctgacccgccgctatcgggggcaagtcgaatcgtcgcaccgcccctcccacattgggtttgcagcgcctgcgagattggggcaggtcagctgccgtagcgcttgctggcctcaatcgccagaccgctgccgatactgccgaagatattgccttccacatgccgcgcattcggcagcattgccgagatgctgtggcgcagtgccgggatgccgctggaaccaccggtaaagaacacggtgtccacctgggccacgtctaccgaagcatcattcagcaactgggtcacgctgttgcgcacacgctcgagcaggccgtcgatggcggattcgaacaaggtgcgactcaggtccacgctcaagcccggctcgacccgatccaacagcacatggcggctgtcttcgtgggtcagttggatcttggtttcttccacttccatcgccaaccagtgcccggcgcgctgttcgatcagcttgaacaggcggtcgatgccgccggtgtcttcgatgtcgtagcgcatgctgcccagggccagctgggatttctgcgagtacaccgagttgatggtgtgccaggtggccaggttcatgtggtggctggtgggcatgtaggcaccgcttttcatgcggctgccatagccgaacagcggcattatgccggccagggacagttgcttgtcgaagtcggtgccgccgatgtgcacgccgccggtggcgaggatgtcgctctggcggttgtcgttgtgacggcggtccggtgacaggcgcaccagagagaagtcggaggtaccgccgccgatgtcgacaatgagcaccagctcttctttctcgatggtggactcgtaatcgaacgccgccgcaatcggttcgtactggaacgagatgtccttgaagccgatcttgcgcgccacgtccaccagggtgttctcggcttcctggtcggccatcgggtcgtcatcgacgaagaacaccgggcggcccagtaccacttcctcgaactcacggccagcggtggcctcggcgcggctcttgagctggccgataaacagcgccagcaggtcggtaaacggcatggccgtgcccagcacgctggtgtcgtgcttgatcaacttggaacccagcaggctcttgagcgagcgcatcagccggccttcgtaattttccaggtattcgtgcagggccaggcggccatacaccgggcgacgctcctcgaagttgaagaacaccaccgacggcaaggtgatcttgtcgtcctccagcgcgataagcgtctcctcgccggggcggatccagccgacggtggagttggacgtgccgaagtcgataccgcaggcacgggctggggatgggtttttcatgtctatcgggttccggttgaaaaacggccgcgcagtgtatgtcagtcgcaggcgcttgcgtaggccgactatccgttaaatcacgcttgaaagtgcgggatttgcccccacatctggtgcatacggctgatgccgataacactttgacgtacccccaggtcaccaccctccacaggtgcaaaccagcgcacgtggtgccccgggcagtgcgatctcgataaaggatggtgaaccgccgatggatttcaaagattactacaagattctgggtgtagagccgacggccgatgataaggaaatcaaggccgcctatcgcaagctcgcacgcaaatatcaccccgatgtcagcaaggaaaaagacgccgaagcgaaattcaaggacgcgtccgaagcctatgaggcgcttaaaagtgctgacaagcgcgccgagtacgacgagctgcgcaaatacggccagcacggccaaccgttccaggggccaccgggctggcagagccgtggtgggttcggcggtggcggcgcgggtaccgaggacttttccgatttcttcagctcgatcttcggtggtcgtggcgacgctttcggtggcggccagcgccgtcctgcggggcgcaagggccaggacgtggagatgcaactgacggtgcacctcgaggaaacgctgtccaccgagtccaagcagatcaacttccaggtgccgcaatacgacgcctcgggccgtcacgtcagcaacaccaccaaaagcctgaatgtgaagatccccgccggcgtggccgacggcgagcgcatccgcctcaaagggcagggcgcaccgggcattggtgggggcgccaatggcgacctgtacctgatcatcaagtttgcgccgcaccccaagtttgaagtggacggcgaaaacctgatcatccatttgcccctggcgccttgggaactggcattgggcgcggaagtcgcagtgccgaccctcaccggcaagatcaacctcaaggtgcccgccggcagccagaacggccagcgcatgcgcgccaagggccatggcttgtcgaacaaggccgggcagcgcggttatctgttcgtgcagctcaaggcggtcatgcccaagaccagcgacgaagaggtcaaggcattgtggcaagcgctggcgcagaaggccgcgttcaacccgcgtgagcatttctgagcggcgatacatagctagggcttgccaggccgggcgattcgataggttggtgttttcgcaacccgtcatggatggcccgctatgtcagagcaacccgtcacgcctccccccgaaggtatgttcaacgttgaccttcggggtgtgcactacgacttcctcaaggaacgtgtgcccgcctggttcaaccaggccactgcccagcgtcagcaagagctcgccgatcacgaactggaactgcccggctggtacttgattgccacggcccagcaaaaggccgacctggccgacaaccatcgtcgctatcgcgagaccttgaaccaggtagaagagcacctgggccagatcgaggatgtactggcctttgccgaacagccgctcaaggacgcgatcaagacccgcttcaaaatggaactggacgtcaggaacgtctacttcgcacgcaagtacgggttcaaaagtcgcgacgacttgtacggcgcctttgtcttcgatcagcaaggtgacccggcgcagcgctatgaataccgcggcgtttccctgctggaagcggccctggccaacttcgcgcctgacgaagagcgggccggtgcctgcgccgattgccaggtgattaccacctggaggggcttcgacagcgacatcatcccgacccccagcgtgatccaggcgcatgccctggccatccctggccatgaatttgcccgactgtgccgcagcctggacttaggcaagcggtatcagcaacacatcaaagacatcgtccaacccacggacgacacccagcgcagcgcgcttgaacgccagctggaagagcatcaccgccagcagttggcgttgagtgccgaggtggcggtgcaaacgcgggagtgggggatcggtgccgacgtctaccgcatgctcaaacacgtcatcaccgaccccggcagcgccaggcttgacggtaaaccggtgacgtttgcggcgctgaagatctttggctgcgtattggtcgggcccttgctgatcggccctggacgcaaagacagtgatcgggtcgagcggctggtagtgttcatccccaacgacccccagcagcccctcaaggaatatgcctccagcggcgatttcatggctgacctgcggacccgcttgcacagcctttcctaccggcgttttttcagccgcttcgtgcctcagcgcgaacagggcatgttctttcaacagttcgatcggttgtacaagcccgccaacggcaatggcgcggccggtgactacccattggccgccaagccggcgcgcttacctctggatgagctggcgatcggcgcaagcctgtggcaaccgttgcgcgacgcccatgtgcgcaagatcctcgccgatgcccgcgccgtggcggtgcccaccggtgacgaagaccgccaggcccgcctcgaccggctggccagctacctggatgccgtgatcagcgcgttcaacctcgcggcctttgtggtgccgggtctggggccgaccatgctcgcggtggcggtgctgcagatgtgcgccgaagggttcgaagggatcgaggcttacgagcaaggcgacctgaagacgatgtgggcacacttttccagcgtggccctcaatgcggcctttatcggcaccggggccaaggtactgcccgaggtcaagctgtcgagtgtggtcgacaacctcaagccggtcaccctgcccaccggtaaacaggtgctgtggaaccccgatctgaccccctacaagatatcggtccaattgcccgcagacacccagcctgacgcccttggcctctaccaccacaatgggcaggcgttgttgccccatgaaggtgatcactatcaggtccgccaggaaccggagaccgggcgataccgcatccagcaccctagccgcccgggcgcctatgaaccgctgctggagcacaaccacgccggggcctggagccatgaagtcgaggagccgctgacctgggacctgccgaccctgatccgtcgcctcggcctgcaacagcgcgggttcgacagcgataccctggagcaggcgcgccttgccagtggcgtcgaggaagacaccttacggcaaagcttcgtcgagcatgaaccggtgccattggtgctcgaagacaccctccaacacttcaaggcccatcaacacctgagcaccttcgtcgagcaaatgcgcagcatcgagccggcactgcaggcccaggctgacccggtgctgcaactgcagatcatgcggcgtggcggcatgttgccggtggatatcgcgctgcgggtggtgagcgatggcgccagggtggtatgggaggaaccgctctgggcaggtgcgtcccggcacgtggtcgtggtcactgaaaaccagttggccggtggtcaattgctcaaggaagtcctgcacaccctgcaaggcgtcgacccgaacctggagacgatccccggcagccctgaagagtcgttggccgtgcgggccgacaaggtgcgggagtccattgccactattgtcgatacattcaagggttcactggtggaagaacgctacaaaacgctgaccgcgagcgatgaccctgacgtgagactggtccagggtacttacctgaagctgccgacgtcgatggccgccgagttgctcaccagcctgaccgatgagcaattgcaggcgtttcgcaacagcgggattttgcccgaggcgcagcgcgaacaggcgcgttggttcgagcaggaaattcgcgtttcgagggcctatgaagggctgcacctggacagcctgaccgacctcgacagccagcgcctggccctgcgcaccctggagaccttgcccggctggcggcggggcacgcgggtcgaactacgtcagtattcagccgaaggcagcctgctcgacgccatcggctcgccggactcgacgcagcgcaagaccctggtgctcaaggccaacggcgtgttcgacgcacccatgccgagggatttctacaccgcgacctgggcccagttgtccagcgtggagcgccaggccctgggcttcactgatgccctgcaaatgaaagccgcaatccggcatgcgccgctgtcgcgccagccgttgcgcacggtgttgctggagcacccgctgcgcaagccgaccgttgagccggggttacgcctgctcggtggcgggcgcggttttcgccggctgctggagcgtatgacggggccttcacaagcctcggcaaaagcccgggccaaagtgttattcccctccatgggcgatgatgaactggacacgtttatcctgtcgttgggcagtgatgtgcgtggcgggctggctcgctacaaagcccagctacagacgctgcagacggagttggcgacgtgggtgcaagccaatgcatcgtcggcgaccgcgcatgatcaaaccccggcctatcgcgtatcccaggagattgagagggcctggcgtcgcatggggtctggcaccctgcgcctgctgatgagggatctggaactgccgccattgagcgctgacttcagccatgtgcagaggcttgacctgtatggggtcaagtggtcaagtcatggggataccttccttcaaacatttaccgggctcaaagacctgagcgttcgcaaaagtggcctcaccgagttgcccgctgccatcggcaacatgcccgacctgacctcgctggacctgagtgccaacaacattcgcctcaccgctcaaagtgctcggatgctcagtggcctgggcaagcttgaaacgctgcggctcactggcaaccgcttgggcattgccccggatttcagtgcgatgccgcgcttgaagcaactgaacctcaggggcgcgcaactggagcagtggcctgcgggcctgaccgcgtgccccgagctggaggtggtcgatttgagccataaccagttgcgtgaggtgcccgtgcaatacctcaacccggctcccgagcagcttgaagagactgcccgagtcaacggggtcaccttgcttgagggcaacccattcccgcccggttactggaagcaattcgataactattggaaacgcctggcggaggctcgatcgccagtggtgacaagcgctcgtgaaggcgcgtttgacagtggcaaccccaggcttgcaaaggtgcggcgtatgtatccgaacaagcgcacgcacgaagccagggcgtggatgtggctgctgggggaggaagccgatgtgacgctggccaggcttgaaggggaattcaataccctggagcgacagttgaacgcctggacgttttcgggcggcgcagaacgccagcgctacgtgcgggcaggcgagcggcgagccaacaccgaaaacctggatgatcgtttccaggctcagcaacggatcctcgcctgctggcgtggggagaccccgcaaaagctcagcaatgacggacaaccgattggcctggagctggacttgagtaggttgacactgccgagcttgccggacctggacgtggatttcagccaggtaggctcgctaaaactgagcaacatgcagctcagtgcgtcgccggaagggttcctggcgcgctttcggcatctgcgctggctggacctgtccagcaaccagttgcgcgaactgccgccggccctgggtgaaatgcccaacctgacccgcctgttcctgaataacaaccagatccgcctgacgcccgacacggcgcagatactgtctgaacgggtgacgttgcgtgcgatatggctgcacgacaatgcgttgggcattgcgccggacttcagccgcataaccgatttgcgcaccctcagcatgaaccacgcaggtcttgaacattggcccgccggcttggcgcaacagccggacctggggcaggtggacctgagaaacaacaacattacgaccatcccagcctcggtcaccgtaccggcaatggagcgggtcaataatgtcaccacggtgtccggtaaccctttgactgaggacactctgcggcaggtgagggattacagccagcaactgggcgggcggcgcaatcttctggtgtacacggcattggtcacccgggtgccaatcggccctgacttggccacccgccaggcatttgggcgctgggtccaagacctgcctgccacacagctgccggccagaatggctcaatgggtcaggctcggccgcgaggaaggggcgcacccattcttcgacatcctcaaccgcctggaacctgcgggcgctggccacgccgacctgcaacggcgggtctgggaggtgattgacagcgtcactgaaaacaccgcgcagtcggacagccaccgcaaggaagtgttcgaccgggctggcgcgccgggttgctgtgacctggcggcgttctccttcagcaacctggaaaccctcacgctggtctacagagcccgtgcccaggccgcagggcagatgcaagcggcacagctggcaagtctttccaagggcctgttgcgtctgcacgaagttgacaagatcgcttctgcggatatccagcgcagcgaggctatcgtcaatgatccctcggtgtcgatgaccgataagttgccccatacccaacgcctggccgaagaggtggagatccggctggcctatcgcttcggcctcaaggaccgtttgcaattgccggggcagccgcagaaggtcaggttcaccagtatgggcggggttaccccggcgatgctggatgccgcctacgaaaaagtcatcgccctggacaactccgccgaggagttccaggccctgttgtcccgtgagttctggcaggactatgtgacgcataaatacagggcgcaatttgaccggctcagcgagccctaccagcagcagttggctgccctgcatgatcagagggtggccgaggcattgtccgacgccctgtatgaggccagggccgatgaactacaggctcggctggtgatcgaggaaagcgggttgatcgagactctgagccggcgggaaatcgctgaggcgttgttgccccgtggtccgctcgaagggttggtcgagcccggcgttggccctgccgccgggttgcagctcaaccaggcgcaagccattgatctggacggcaagcaatactttatcgcgagcatgcccgatgcccgggatggcgagtactacgtattgtgggtgcaggcagcgcagaatccatttgccctggtcagcagcggtatcgttgccaggcccgatctcgacggcgtgtggaagcgcaggggctcggcgggtggcatgcgctccggcagctccagcgatgagcttgaagaggcctccgagtccatgccggtggagccctacaccgggctcgaactgagtgccatgaagcgcgaagtgcatttcacccaactgcgcaacgtacccggcagttatgaccgcgttaacaacggcaggtacccgctgaggaacctgcaaggcaaaccgatgcgtatccgaaaactgcagagagaagtcgtgacctactcgggcgtcaagtacagctcagagcagatcaagccttacatccagtttgaaggctacgaaaaggtggcagcgcgttatgacgagaagctgcagcggcgcgtgttcactgcccaggacatgcaagtgcccgaggaaaaagtgctgatcggacagtccatggtggtggccaaccggcgtattgccaaaggtgaaatcctcggcgtctacggcggcaccgtgctgccctctcaggtcgcaagcccaggtgggcagacctatatcatgcttgcaggcgccaggccgacccctggaaaactcggcatggagccgatcgaaatctcgggggataacatcctctccaggatcaatacccactttgaatatgacgccaacggcaagcccgtacgccaggccgccagcggctacaacgttgaaggggtagggttcgacgtcgaagtggaggaggggcagggtgccaagagcaccaggagcactatgatcctgacggcgatatttgccattgaagatatcccggcgggcgtcgagctgcgcatggattaccaatacagcgaaggcatgatcgcgacgttgtttgcgtagtctccactccctgcaggcgcgagcttgcccgcgcctgcaggggcgggttcaaaacaggaagtaacgctgggccatcggcagtacatccgccggctcgcaccacagcaactggccgtcggccttgacctgataggtctgtgggtcaacctcgatctcgggcaggtagtcgttgtggatcaagtcggttttctgcacatcgcgacagcccttgaccaccgcaatctgcttcttcaggcccagggcctcgggcaacccggcgtcctgggcggcctggctgataaaggtcaggctggtggcgtgcaacgcgctgccgaagctggcgaacatcgggcggtagtgcaccggttgcggcgtggggatcgaggcgttggcgtcgcccatgaggcttgaggcaatcgcaccgcccttgaggatcaacgtcggcttgataccgaagaacgccgggcgccacagtaccaggtcggcccacttgcccacttcgatggaaccgacgatatggctgatgccgtgggtgattgccgggttgatggtgtacttggcgatgtagcgcttggcgcggaaattgtcgttgccggggccatcgccgggcagggcgccgcgctgttttttcatcttgtcggcggtctgccaggtgcgcgtgatcacttcaccgacgcggcccatggcctggctgtcggagctgatcatcgagaacgcgccgaggtcgtgcaggatgtcttcggcggcgatggtctcgcggcggatgcggctttcggcgaaggccacgtcttcggcaatgctcgggtccagatgatggcagaccatcagcatgtccaggtgttcatcgatagtgttgcgcgtgaacggccgcgtcgggttggtagagctgggcagcacgttggggtaaccgcaggccttgatgatgtccggcgcatgaccgccaccggcgccttcggtgtggtaggtgtggatggtgcggcccttgagggcagcgagggtggtctcgacaaagccggactcgttgagggtgtcgctgtggatcgccacctgcacatcgtattggtcggccacgctcaggcagttatcaatgcttgccggcgtcgtgccccagtcttcatgcagctttaagcctatggcgccggccttgacctgctcgatcagcggctcgggcaaactggcgttgcccttgccggtaaagccaatgttcatcgcgaacgaatcgctggcttgcagcatgcgcgccagatgccaggggccggaggtgcaggtggtggcattggtaccggtggccggcccggtgccgccgccgatcatggtggtgacgccgctggtcagcgcttcttcgatctgctgcgggcagatgaaatgcacatgggagtcaatgccgccggcggtcaggatcatgccttcgccggcaatcacctcggtgctggcgccgatggccatggtcacgccgggctggatatccgggttgccggccttgccgatcgcatggatgcggccgttcttgaggccgacgtcagccttgacgatgccccagtggtcgatgatcaatgcgttggtgatcagggtgtccaccacctcatgggcgagcaactggctctggccctggccgtcgcggatcactttgccgccgccgaatttgacttcttcgccgtagacggtgaagtcctgttccacttcgatgaacaggtcggtgtcggccaggcggaccttgtcaccgacggtggggccgtacatgtcggcgtaggcttggcggctgattttcatgtgtggttgccctgataaagatgtgttgaatgtgcgatcgctatcgggggcaagccccctcccacacttggaatgcattcccctgtgggagggggcttgcccccgatgatgccctaaaggtcacccatgacccgccctgcaaacccaaatacccgccgccccccgcttaaatccaccaactccacctcccgccgttgccccggctcaaaccgcactgccgtgcccgccggaatattcaggcgcatgccacggcttgcggcacggtcaaactccagcgcgtcattggtctcgaaaaaatggtaatgcgaacccacctgaatcggtcggtcaccgctgttggccacgtcgagggtaagggtacggcggccgacattcagttcgatgtcgcccggctggatctggtattcgccaggaatcatgcaggttgccccagggtcttgaagtagatggcggtcgggctgtagcgcccgtccgggctttggcagtagtcgggcagctcaccgaccttggtgtagcgcagcgactggtagaaggcttcggcgccggagccggcctcggtgtccaggtacagcaggccgcgcttgtgctggcgtgcggcgagctccagagtgttcatcaattgctggcccaggccgtggcggcgggcgctgctgtgcaccagcagcttttgcacttcagcgcggttgaggccattggctttttggcacagcgccaactgcacgctggcgatcacctgctcgtcacgcaccaccacccacagcagcaggctggcgtcttcgatgctggcttgcacgccgctcaaataggtgcgggcctgggcttcgtcgaagtcgtccatgaagcccaccgaagcgccatgctgcaccgcatccagcaacagctcgatcaagcccaggcggtaatgggcaaaactttcagcattgactcgacgcagttgtgcagcgttcatcgatcttactccttgggcggttcggcgcccgggttcaaggtcagttgcataaaggtcaggtccagccagcggccgaacttaatgcccacttgcggcatatgcccggtggtgatgaaacccaggcgctcatgcaggtggatggacgcctggttgccgctttcgatggctgcgaccattacgtgcttgccgccgctgcgcgcacgctcgaccagcgcttgcatcaagcgtgggccaaggcccttgccacgttgatcgttgcgcacgtacaccgagtgttcgacgctgtagcgaaagccttcgaaaggccgccagtcgccgaaggaggcgtagccgatgacttcgtcgtgttccaccgccaccaggatcggatactgctgggcctggcgcgcactgaaccaggcttggcggttggccaggtccaccggttgttcgttccagatcgccgtggtgttgagcacggcgtcgttgtagatgtcgcggatcgccggcaggtcgtgttcggttgcatcacgaatcatcacagtgcctcacgcaatgggctggtggacggtgaccagcttggtgccgtcgggaaaggtggcctccacctggatatccggaatcatctccgggatgccttccatcacctgttcgcggctgagcagcgtggtgccgtagtgcatcaggtcggctaccgtgcggccatcgcgggcgccttccatcagggcggcggagatgtaggcgatggtttccgggtagttgagcttcaccccgcgtgccaggcggcgctcggcgacgaggcctgcggtgaagatcagcagtttgtctttttcccgtggggtcaggtccatggttcaaggtccttcaaagaatgcattcttgaatttgacagagatcaagtgtgggagggagcaagccccctcccacattttgatcttcatgtgctccagattcttggtgatattgcttctctgccgagtatggccgggcgcagcaatcgccatagatctatcaaccaccctcgcgccagcagtgcttcactggccaggcagcgggcgaccagcaagcccggcaattgggtcaaatcgccgcgcactgcgtggggcagcgagcggcaacgctcaagcaattcaggctcaacctcacccgtcaccagcaatgtggcaaacaccggctgcccattcagcccgataggcgaatccagcagcccatcggcgcccacgatgcgctggcgctcatgccagagcaactgcccgtcgcggcgaatatccaggtgtgattgaaagtggccgaggtcgaaccgttcgccgctggccgggcgccccagggcgaccacatcccaatagaacaaccgcgcatcgcccaagagctcgatgcgcgtagtgagttcggcctgggcggcgctgaacacgatggtttcctggggcagccattccagcgtcgcgccggcctcgacggtcaactctacttgctgaaacgccgggccgctggcgcggtaccacttggcggcgccggggctggtcagttgcgcccaggccccagtgccgacatgggcgctgatgtccaggcgatcaccgccggcaattccgccgggcgggtgcacgatgatgtgctggcacaccccggggccctcggcgtacaggtgcttttgcacccgcagcgggccaaggtggcggcgcaataccgggcgggtggtgtcgccgaaacgtgcatagccgagttccagctcggcgtgccagctgggggtgaacagggcaggggatatgggcaggttcatggctggttgcttatcgtcaggaggctacagattagatggttaccagcccacgtacaccttcgctttccatattttcaccgcggccttgctgcacgatttcacctcgggacatcaccaggtactggtccgccagctcggcggcgaagtcgtagaactgctccaccagcaggatcgccatatcgccgcgttccgcgagcttctttatcaccgcgccgatttccttgatcaccgacggttggatgccttcggtgggctcatcgaggatcagcaggcgcgggcggctggccagggcgcgaccaatcgccaattgctgttgctggccgccggacagatcgccgccacggcgatgcttcatttgcagcaacaccgggaacagctcgtagatgaaggcgggcacttccttggcttcggcgccggggaagcgcgacaggcccatcagcaggttttcttccaccgtcagtcggccgaaaatctcccgaccctggggcacataagcgatgccagcatgcacacgctggtgaggcttgagtgtggtgatggccttgccttcccaattcatcgcgccttccttggccggcagcaaacccatcaggcacttgagcagggtggtcttgcccacgccgttacgcccgagcaggcaggtgacttcgccgatcttcacgtcgaaggacagcccgcgcaggatgtggctaccgccgtagtactggtgcagcttgtcgacttgcagcattctcaaaacctcctcaatcccctgtaggagcgagcttgctcgcgaaaaacctgagggcgccacgtgcattcaggatgcccgcgttagcgttaacgatcttcgcgagcaagctcgctcctacaggaaaaccatcttagcgaccgaggtagacctcgatcacccgctcgttttcctgcacctgttccagcgacccttcggccaatacgctgccttggtgcaacacggtgacgtggtcggcaatcgagcccacaaagcccatgtcatgctccaccaccatcaaagaatgcttgcccgccaggcgcttgaacaactcggcggtgaactcggtttcggcgtcggtcatgcccgccaccggttcgtccagcagcaacagttgtgggtcttgcatcagcagcatgccgatttccaggaactgcttctggccgtgggacagcaagccggcgggccgctgcaccgaggtggtgaggcggatggtctcgagtatttcgtcgatacggtccttctgctcgccgctcaggcgtgcgcgcaggctggcccagaccgacttgtcggccttctgcgccagctcgaggttttcgaacacgctgagggcttcgaacaccgtaggtttctggaacttgcggccgatgccggcctgggcgatctgcacttcgctcatgctggtcaggtccagggtttcgccgaaccaggccttgccgtggctgggccgggtcttgccggtgatcacgtccatcagcgtggtcttgcccgcgccgttggggccgatgatgcagcgcaattcaccgacgccgatgtagagattcaggtcattgagggccttgaaaccgtcgaagctgacgctgatgtcttccagggtcaggatggtgccgtggcgggtgttgagccctttgcctgccgcctggccgataccgatcgcatcgcggccgctgccggcatcgaaaataggttcaagcatgacgttcctcattttttcagcaggccgataacgcccttgggcaggtacagggtgacgatgatgaacagcgcaccgaggaagaacagccagtactccgggaaggctacggtgaaccagctcttcatgccattgaccacgcccgcgccgagcaacggcccgatcagcgtgccgcgcccgcccaaggccacccacacggcggcttcgatggaattggtcggcgacatttcgctggggttgatgatgcccacctgcggcacatacagcgcgccggcaagcccgcacaacaccgcactcaacacccatacgaacagcttgaagccacgtgggtcgtaaccgcagaacatcaggcggttctcggcatcgcgcaaggcggtcagcacccggccgaacttgctttgcgccaggcgccagccgatgtacaggctcgccaccagcaacagcactgtcgccacgaacagcaccgcccgcgtagcgggttcggtgatgccaaacccgaggatgctgcggaaattggtaaagccgttattgccgccaaacccggtctcgttgcgaaagaacaacagcatcccggcaaaggtcagggcctgggtcatgatcgagaaatacacacccttgatccgcgagcggaaggcgaagaagccgaacaccaatgccaacagtccaggcgccaagatcaccaggcacaaagcccagaggaagtggtcggtgccggcccagtaccagggcaattcggtccaggacaaaaaggtcatgaacgccggcaactgatcccctgacgcctggcgcatcaggtacatgcccatggcatagccgcccagggcaaagaacaaaccgtgacccagggacagcatgccggcgtagccccataccaggtccaaagccagggcgacgatggcatagcagagtatcttgcccaccagcgtcagggtgtaggcggagacatgcaaggtactctccgccggcagcagcgacagcagcggcaatgccagcagcacggtgaggatcaccacgccgacggcaatcgtcaccttggggccggccttttgcgtggccgtgagcatcaatggctgattcatcagtcgatcacccgtcctttcagtgcgaagagtccttgcgggcgtttctggataaacagaatgatcagcgcgaggatcaggatcttgccgagcacggcgccgatctgaggttcgagaatcttgttggcaatacccaggccgaacgcggccatgacgctaccggccagttggccgacaccgccgagcaccaccaccaggaacgagtcgatgatgtagccctggcccaggtccgggccgacgttgccgatctggctcaatgcgacgcctcccaggccagcgatgccggagccgaggccaaaggcgagcatgtccactcgtccggtgggcacgccgcagcaggcggccatgttgcggttctgggtgacggcgcgcacgttcaggcccaggcgtgtcttgttcagcagcagccaggtgagcactaccacgaacagcgcgaaggcgatgataacgatgcggttgtacggtagcaccaagttgggcagtacctggatgcccccggacaaccaggcagggttggacacttcgacgttctgcgcgccgaacaccaggcgcaccagttggatcagcatcaggctgatgccccaggtggcgagcagggtttccagcggtcggccatacaggtggcgaatcactgtgcgctccagaaacatgccgatggcggcggtgacgaagaacgccaccggcagcgcgatcaacgggtagaactcgatagcagcaggcacatagcgctgcatcatcagctgcaccacatacgtcgaataggcgccgagcatcagcatctcgccatgggccatattgatcaccccgagcagaccgaaggtgatcgccaagcccagcgccgccagcaacaggatcgaccccagggacatgccgctgaacgcctggccgaggatctcgcccatcatcagtttgcgcttgacctgggccaggctggtttcggcggcggtgtgcacggcggcatcggtttctacgcctggtgcaagcagcgcttcaaggcgggtgcgggccagcgggtcaccggtgctgccgagcaagcgcacggcagccagacgcaccaccgggtcactgtccaccagttgcaggttggccagggccaggctcagggcggtgtgcacaccctcatcggtctcggcggcgacctgctggtcgaggaatttcaactgcgcaggtacggcgcttttttgcagggtacgcgcggctgccaggcgcaccttggggtcggcggcgagcaactgctggctggcctggacgttattgatcaagccgcgcaggcggttgttcaggcgtacggtcctggtctcgccgttgagcgtgagctggccttgttgcagggcgtccaccagctcgatgcgcgccgggtcgggctgggcggcccagtcctggagcagcttggcttgttgcgtcgggttggcggcgaggaagtcttctgcgtcgcctgcatatgccgccaaaggcagcaacagcagcaatgccaacaagcagcgtgggagggcagtaggcataacacaatgtcctagtcatgcgcggtcaacactgtgggagggggcttgctcccgatggcggtgtgtcaggcaatgcatgtatcactgacccgccgctatcgggagcaagcccactcccacatttttgatctgtggtgggctttagttgctcttcacggcatagtccggctttttgtcattgcccggaatgtaggggctccacggctgcgcccgaatcggcgcttcggtttgccacaccaccgagaactgcccgtcggcctggatctcaccgatcatcaccggcttgtgcaggtggtggttggtcttgtccatggtcagggtgaagcccgacggtgcggcgaaggtctggccgcccagggcctcacgcactttgtcgacgtcggtggacttggcttgctccgccgcctgggcccacatatggatgcccacgtaagtggcttccatcgggtcgttggtcacggctttgtccgcccccggcaggttgtgtttcttggcgtaggctttccaatcggcgacgaacttctggttcaccgggttttccacggactggaagtagttccacgccgcaaggttgcccaccagcggcttggtgtcgatgccgcgcagttcttcttcgcccaccgaaaacgccaccaccggtacgtcggtggctttcaggccctggttggccagctccttgtagaacggcacgttggagtcgccattgacggtggagaccaccgcggtcttgccgccagcggagaacttcttgatgttggcaacgatggtctggtagtcggcatggccgaacggggtgtagacctcttcgatgtctttgtcggccacgcccttggcatgcaggaacgctcgcaggatcttgttggtggtgcgtgggtacacatagtcggtgccgagcaggaagaaacgcttggcgccgccgccttcttcgctcatcaggtactccaccgccgggatcgcctgctggttcggtgccgcaccggtatagaacacgttgggcgacatctcttcgccttcgtactgcaccgggtagaacagcaggccgttgagttcctcgaacaccggcaataccgatttacgcgacaccgaggtccagcagccgaacaccacggccaccttgtcctgggtcagcagttgccggcctttctcggcgaacagcggccagttggaggcagggtccaccaccaccggttcgagcatcttgccgttcacaccgcccttggcgttgatctcgtcgatggtcatcagcgccatgtctttaagcgaggtttcggaaatcgccatggtcccggacaacgagtgcaggatgccgaccttgatggtctcggcggcctgtacggtccaggtcaagcccatggcaaccagggatgccgacaaagtaaaagccttgatcaagctacgacgctgcatggtgcgatctccgtaaaccgatatttttatgagggcagatacacaggactttgcaaaggctgtgcctgcggcgcaaaccaccggtgtcgttgatcgattgctgcgggcgttggcaagggcgtgcactagcttggcgccgcaatacccgcaaagtgcatgcagagcgctaaaacggggcatggagatagatatgcagcgcaagcaccgtgcagggatgttccagcatgagggttcaggtaaggcgtacgcgatgcgccttcgctcctttttcgcgagagcttttatggacaagacccccggtacagcagcccacccgtcaacccaggccgttcatttgccgcctctgagcccgccttttatcagtgcagacgacgccgtctactgggcgcaccgtcaaatcctccatggcctggaatgggaattcggtggtgtgattttgaaagacaaagaaggttatttccgcgcgaccgcccccaaacacggtgaagcgttcattttccgtttcgaggaggtgctgccggcagacaaggttggttaccctatcgctcctgctgggttcgaggtggttgcgatttatcactctcatgctgcgcggcatggtcaagtgcgcgcaacggggttgacagatgccgagacgcgcttcctcctgggttcgttcctccccgaggaaatgctgtttaacctcaacctgggcgcgggggtgccggtgcattatttgtcggggccggacgggtctctgatcaagtatgtctgcagcggtagtgccaccgaacatgcgttgtttgagcgattgttggaagacatccagggcaccgcgcgcgacgaatatgtacatacgttaagccaggaaagtgccgctgcgggcgagctgtgggtggtggtgcccaatcaagagtggggaggcgtacggggccgggtcaagcctgggtgggagataggtactgccgtgacctcaagggttgaggcgttacctttgtgtacccgagtgtttgcactggccgacaaagcggccatggctgctttggacaaccgcgcgccagccggggcggtgacccatgggtttattctcaaaagtacccagggctatgtggccacttggccggagccggcaactccaccgtggttctcgccagctgtactctttcctgtcgatgataacggcagtctcaggctgcctgagcattgcgctctacaaggtgcctacgtcgtggtgccagacaaggtgggagggctatccagcgtgcccgagccctggttatacaagtcgatgttttcggcgttgcaactggcggtggggatcgggcagctaaaggtcaatgccgacttgggcgaccagcattcgccgatggacctgtatttcaaaaccagcgaccgcgccgtattgcgttaccggcttagcgggtcggcccaggaggcgacgctgtttaccgagcctgcacctggccgcttcagtgatgacggcagcgagcagcgcatggcctccggtgccctggcctcgcgcgattatgtcctgcgcgttgcccaggccggccagttggcggtgatccgcaccagccaggtctgggacgaaaaaaccacgctgacccaggactggcaaccgtattcgatcaggcaacagccattgagcccggcgtttgtcacggcggacgacgcggcgcggtatgcccatgcgcaagtggactacggacgcttgagcaactacgccgcattgatcctgcagcgggccgaccagcgctttatcgtcacgcagcctgtaagtactcagcggccgcgttttgccttggatgcggtctacccattggatgaacacggtgcgctgatcatgctgaccccaagctgtcgactgcacgcgttgttctgctccagggctatgtccgaggcgccgcagggcctgagtgccagcgaggcccaggttgcgcagcagatgttcatggacaccgatatccataccttgctctcgaaccgccaggcggtagcttgcgggtacctgtctggctcggtcgacagcctgctggcctacaccacgcaagacctgcagacctatactgaacgtgagttgctggagcgggtgacacccgtgcagggccacagcccggtggcccgcgccttgtcgggcggtgagctgttgcccagcgccttcgtgcgtgaacaagcctatcccgggcgactgcgtgttgtggttgccggacgcctgtggggcgccgcggggcccttgcccgaggattggcaaccgggtgacaccgtcgatatcacgcgactgccgcaaactcctttgctcagtcaggtttttgcctcggcggcggacgccgtgcgtaatgcccacaagagcatcctggatcgctatggtcgtccccccagcggcctgggagtggtgctaaggcatcgctcactggcgcagtacgtgaccacacaatggcttgccccgcaacggctcgatcaactgctgcatacctgccgctttgccgagtcgctgcaacaggctgggtttgaagtcgacagcttttacctgtccagcgtgcgtgtgcctgattcggcaaccgcttcgggaggctggctggcgcggcactttatcggcccaggggatttgcaggcggccatttacgataacgctggggccaggcgcttgccgctggcgcagcgattaacgctgcacattgcgacacttgaaggcgccttgctggcgtatgacgcaggttccgatgaccggctgttcggtgccgatgcgcaagccggccaggcgtcgttcaagcgccgcctcgacagtgacgagctgtccaccaccgattttgtccggcacgttgcgagcgcgggcgcgttacgcgtggtcgatgccagtgagtgctgggaccaacccggtcagattaaccccagctgggcgccattctccggcatgacgcgtcggcgcctgagcccggcgttttcctgcgccgatgatgcggcgcggtatgcctccacccgcttgggcgaccggcgtgaccaggtgtatggcgggctgatcctgcgctcgaccgcaggcctgtttgtcgccaccgagcctttggtggtgcatgtggaaaactttgacgtgcagtgggtccgctccagggagctggtggataaagggctgtttctggggggcagtaccgtggtcgccttttatcatagttgcagcgcgtatgagccgcagtttccgaccacggatacgcaatggaatgtctaccgcaacatgtactccacggcgtttgtggcggatgtgctcagggacccgtcgcagcaggcggcgtcgccgcgcactgattatctgttgtgcaacgatggcgcgctgctgcgttatcgcttcaccggcaatgcagcgcaaaaggcgttggcggctgagctcaacgtggctcccgctgaagcaccatggcacctgtataacccgatcgaagagcagattcgggccggcatcttgcaaccggccgaatgggtcaatcgtctggcctacgccggggagttggccgtcttgcagggcagccaactgtggggtaacccgcgacctgtggtgtcgtttttaccctatgaggtgcggttggacttgtcgtccggcagccctgtgcaagcggataccggcttgacccccttgttcacccaggcggcggacgccgtgcgttacgtgcatcgcctgagccaggagcgggagcagcacacgtgcgggtttattttcaaggcggcaagtcatgcgcatttcatggcgagcctgccgatgtccatggaggctgccgccgggttctcgctcaatcgtgtattgctcgatgggcaacagccccaggggtttgtagtcaacggcctgtatttgcgcgcgcgcattgagccgcaggccaaagggccaagctcggtacacagtggcttgcggccccaggacttggcggcaggggcggcaactgcagcccgctatggtcatgtaccgctctatgttctatgtgccgacggcacgcttttgcaactcgacacctcaagtgctgtaagcgagcgggattctgtagaggcgacattgcgcagggctactcctgtgcctgcacccaatgatcatcggctggcgttaagcccagtctttgtgcattccgacgatgccgcgcgttacgcccagcgtcttgtcgggccgtaccagggcgatgatttccttggggcgattcttgaggatctgcaacgccgcgcctatgtggccgtcgaacctctgccagacaacgaccccgacgcggtgcccagcgccgaggaacgcttgttctggaaagtcagcagggcctcgaccagtgaccatgaagttccgctgcctgagtaccccgaaggccatcgggtggtgatgactcaccagttgtacaaatccgactttgcccaaggcaaggaggacgccgccacgtctctgggcgtcaacttcatttcctggagctacatccatcgctacacccggggcctgaggggctatttcgacattcagaactattacctctcgacccgcgatggtgcattgctcaggtataccccggactacagcgtcgattcgcaggaggagacgatggtccatcagttcaatcacataggtgtttatgacgcccgcgagatgctgcggctgatggcaccctacaagaccttgaatgtggtgcttgccggtcatttctggaggcgcaaagggctgatcggcgatgagcttgcggcaccggtcgccaaggcttcacctacggtgcaggatgcgccgccgggggacggttttcatcgggagaaggatgagttttaaccgcaatagttgagactggacagcctgtcggcggtatcggtttttaaaccatgcgataactatgttgtgcctgtgcgtcttgctgacggttgaaaatttccagctttcattcaaccgttttcagggagatccgccatgacggatagcacgcaatcagctgatccaccggcaccgccgccgccgacgcttacctctctcagcgcagcttttatcagtgccgacgacgccgcgtactgggtgcatgagcaaataggccgtcagcgcgacagagaatatggcggggtgattctcaagcacaagaaccgttatttcgcgaccacaccacagccgggtaaggcctcgtcatttaccctgaacgaggtcttcgatacggcaaatgacggcacgcttatcttgccgccgggttatacgtgcacggcaatctatcattcccatccgcttgattacgcggcgtatgagggcacgcactttaccgctgatgagcgcacgctcctgctcgggtttttttcgcctcccgacatgaaagtcatgattggctttcgtcacatcgccggcacccattatttgtccgggcccgaaggctcgctgctcaagtacgtggccagtggttcgcccaaggagctggcgtttttaaagcgtttggacgatggcgaccccagggatatggatgtgcacgaagacgtcatcccacagttggccgaagcgggcgagttttcagtcctggtggccaacgccgtttggggcggtgtacgcgggcgtgtcgacaaagactggcgcatgggggaccgtttggccggggggcaggcactgcacccgctgtttacgtcggtattcccaggtcgggacctggaaaagctgctgccggtgaataccgccgcgtcggcccagcccgtgttcgggtatgtactcaaggccatcggcaaggacgaatacatcgcccctgttcccgcctgggaacagcaacgtctcgtggcacccgaagcgttgtttatgaaacgcgccgagggccgcgtacgcctgccgtccaactttcggattgatagggtttattgtcggatacagccgaaagaaacgtggcagcatcggtattttttcaccccctcactgttggctgccacccttgcccagtggcgtgccgaccctgcgttatacgactcgcaccggcgtctgacgctgatgttgcgaagtgccgatgacgcgttattgtcctacaccttttccggttctgaggcagaagcccagttcctttctgatgccggggacgtggttgaaacgcgaatgaaagaggccaggtttacccctgcccagtttgtcgagaaaatggccaggttgggtgagttgaccgtggtgcaggccgggacagtatggaaacgggcgggacggttcgctgttgagcccctggctgctgaaacgctgtcaccaagcctgagcccggcctttatcagtgccgacgatgccgctcgctgggcacacgcagctatcggccagcgtcgcgatgtcgagtatggcggcgtcattctcaagcgcggcgaccgctattacgctaccgatcctgtggcggaccaacgcaacagctttgatcatgggctagtgttggccaaggacgatgaaggccacttcatcgcccctgacgattatgtcgccgaggccttctaccattcccatcctgccgatgccgcgcaaatccagggtatgtttcccagcttcacggctgaccaggtgcagctgttcaacaactactattcggtggcggaccaactcttcagcttcaggcagcgggcgtttgccaagactcactatttttccgggccggataacgtgttgctcaaatatgtcagcagcggttctgcgacggaaaaaaaactggagcagcagttgcgtgatgggacgcttgagcccagcagcgatttcgaacatctgatctggaaactggccgaggccggcgaactctgggtggtgatcgcgaaccctgtgtggggcggcgttcgcggccgcatcaaccacggctggcggatcaggacggcggcgataaccgggcaacaactgccgtttttcaccgcggtgtttccaacccctgaaacggccgtgttgcgtgcactgttgctctccggtgtgaccgaccaaagcgccaaggtagggttcgtgctcaggcacagccgtgaggaggcctacgttgcgaccttggcgttgcccaagcgtcacccgctgttctcgctcgacggggtgtttcctaaaggccccgacggcaaacttcgattgccttcccactaccggctggaggccatctacttcaccagtttttacgagacccatgaagtcgcggcgcgggaaaagtggctggccagtactttctttacaccggcgcaggtggtggcggcgacccgtcaggcgcgggcgaccctggagttacagaacacgggccgtggattgtccctgtatatgcaagcctcggacggtgccctgctggcattcaaggtgcccgaggccacacccgccagtgagttggtccggcagggcagcggtggcgagttgaacgacaacggtgcacaggccgcgctgctcagcggcaccctgagcccgcgcgactatgtgcgcagggtcattgcggcaaccgaactgtcggtggtgcaggccggtggcttgtggcgcaaggtgggcagtgtggataaccgctccgacctgttgacgtcgttctacacggcgaccttgagtcgctcgtttctctcggcacgggatgcggcagtgtatgcccatgagcaaattggtaactggcgtgatcgctactacggtggttatgtgctcaagggggaagacggacgttttgtcattaccgaacccatcgccagcgccgccaacccctttgcctttacgttgttttttcctctgggccacgccgggccgttgatcccaccggaaccctatgtgctgtatgcgcgctacggctcgcacctggcgctgtctatggctgacccggtggcggtggcacagcgcggctggactcgcgatgaagcgcagatcaaccagcaagtgttcagcactgccgaaatctactcgatcatcccggctggccggcccgcgtatctgtcgggggcgcaggactgtctgttggaatacaccccgaacaactcgtcccaggaaatgttgctgttggccaacctcagcccgcaggccggtgaagacagcctcggtaaacgcctcgacagtgggcgtatcaaacctgccgattgggtctggcgcctggccgaggcgggagacttcaggattattcaaggcaatgcgttgtgggggccgcgctcggtggtctacaacgactggacgcccaactatacctacgcccctcgatcgggcccacctgactacgtcacctacggtgcggtgtttgccagcgccgatgaggccgcgcgcaacctgcatgggcgcgtgcacgggcgcaatttcgcctattcggcctgctttgcgttcatcctcaagcacaaggaccaggaacagtacattgcgagtgaggtcgtgggtgtcgccgctcagaccaagctgttcaatctcaatcgcttgtttgagctcaaggatggcggcggctatcggctgcccgacgggtttgaagtgcacgggctgtttcgctcgcagcagtggtcgccttccgggttgaacacgtcgaacgcatggctgacgctgttttttgtcacgccggatgtgctgtatagcgcgctctatgccgctgatcgagcgggtgcgaaaaaaccgtcgatgtatttttcgactcttgatggtgcgttgttgcggtatgtgcccgcgccccttgatgtaagcagcggcggcccggcagatacgttattgacccaggcgcaggaactgttgaactcaggtcgcaagctccccctggatttcctcagggagtgggcgctcaaaggcatgcttgatgtggtgcgtaccagtcagtattgggataaaaaaggcttggtctccatcacatggagcggttacgaaactttgatgccgcggcgtttgagcccctccttcgccaatgccgatgatgcggcccgccacgctgcggcgaggctcgataatggctatcgtcgggcttatggcggcgtggtcctcaggctggtcaatgggctgttcgcagcgacggaacccctggcgctgccgccccaggggtttgcgctgaattggatctaccctgggcaggcggtcgcggcggggttgtatccgggaggcagtacgattgtggcgcggtatcggtccctggtggaccaggagttaccgctgctgctgtccgcgactcaaaaagccatctaccaaaccatgataccgagtgcagtgctgggatccttcttgcaccgtgagcgccatctcaaccgggagtacgtattcggcgcaaggggctcgatcctcagttaccaactgtccagcgccgccgaggagtcgttactcatgcagcgtctggcacccctgaatccggtgagggcggattacggcgataacctcatcgaacagcaaatacgcagcggggcactcttgccgcaggactttgtgactgaggtggcaaaggctggtcaattgcgtgtggtagagggggatcgggtatgggggccgccaagaacgatcatggcgagatttttaccgaatcaacttcaagtcaacgccagggatattcgcgcggtgttcctcgatccgccctgcggtcccctcttcacccaggcgtacgatgctgtccgttacgcccagcgtttgggcaaaccgcacacagacgtggcgttcggttacgtactgaagtcagtgaacaagccgctgtacatgacaaccttggcgctggttcgagaaaactttgccgacttcaggcaggtatttgtcgacgggaaattgcctcagggctatgtgattgatggcctgtatctttacgcttccaacgttgccatcgcccctgcggatgatgaaatggcgcacagtttcttcccaccccatcgcatcgccagcgcgctcaacttcctcacttatgcacgcaacggtaatattttgccgctttatttgttgtgtggtgacggtgcgttgctcaagtatgtgtttcccaaaagtgcgccattgtatccggtgaccggtgaggcacatctggatcgcacgaagctgcttgaaggtactctcaaagtgcgcgattacgtgcgccgcctggcgagtgccggagagctggatatccgagtcaccagtgaaatctggggcaaggcagagcgggtcactggcgattgggaaccgaagaaagccccccatgtgtttgccgatgccccctattttcattcgttttgcgggccgctgtttctttaccccgatgatgctgcccgttatgcccagagcttggtggcaccgttcaaggccaagcagtacctgggcgcggtattgacgccggagagtacgcaggggtatgtggcgatcgatccggtggaggaccaggatgcaggcggtataacgaccctggtgcggttattccgcggcgctcatgccgggttggaagtacctgtggccaatgtactgagcacctacaagattgccgctgtgcagttcttctatcagtccatccgttcagcttccagctttgaacagatagaccaagcgcttttgcaaaacttcgtttccaaggacgacctgcgcaacgctgtgtcggtgatcaagaataatgttcccgatgccaagagttgttatctctcctgccggggcggtgctttgctcaaatatgtaccggcctttacccaagctgaaaccacgctgctcagcccgggtttaccgccggacccgaaagtgctgatcagtcggctgagggcccaaggcagtctctctgtgctggtcaccgattttttctggtcgcgggcgggcgtgctgggtgagcactggagcgttaacgaggagcgggtagagtcacaaatcgacgagttctggtatgcacgggaaaaagatgagctctgatttcagcgcctgcgcatcagaccgataaaaaacagcccgccgatcgctgccgtcgccacgccaatcggcaggtcttcaggggcgatcagggtgcgtgccgcgacgtcgacccacaccaggaacacactgcccagcagtacacacacgggtagcaagcgccgatgctcggcacccaccaggcgccgggcgatgtgcggcaccatcaggccgacaaagccgatggagccgctgatcgataccagtacgccggtcatcagcgacgcgatcaggaacaccttgagccgcacgttgcgtgcgttcaggcccagggtcacggcggtctgttcgccagccatcaaggcattgagcgggcgggccatacccagcagcagggccagccccatgactaccgtggcggcgggaatcgacagcaattcccagcgtgccagacccaggccgccgagcatccagaacatcaccgccgaggcggcgcggtggtcgcccatgaacagcagcaggttggccatcgccatcatcacaaacgacaccgctacaccgcacaacagcaggcgatcactgtccagtcggccgttgcgactggccaccgccagcaccaccaacatgctcagcagtgcaccgacgaacgcggcaatgggcaaggtcaacaggccgatgatctcacccacatgcagcaccacgatcaccgcgccgagggtggcgccggaggtcacgccgagcaggtgcgggtcggccagcgggttgcgcgtgaccgcctgcaacaccgcgccgatcaacgccagcccggcgcccaccagcgcccccagcagcatgcgcggcacacgaatcagccacacgatatgttcctggcccatgctccagtctacggcacccataccgaacgccttgttcagcagaatccgccacaccatgtccaccggaacccgcgccgagccgaaccccagggagactacgcaggaggccagcaacaacgcgccaagggcgcccaataacagcaggtagcgacgggtaatcattcgccgtggaaccccttggccagagctttgaccgccagcacattgtcgatacctggcgtggcctgcacgtaggggatcacgataaagcgctggtgtttgatcgcgtccaccgcttgcagggccgggttgttcagcaggaactgctttttctgctcggcagtgatttggctgtagtcgacgatcacgatcacctgcgggttgcgctccaccacggtttcccagttgacccgggtccagctggcgtcgatgtcatcgaggatattgcgcccgccagcggcgtcgatcagcgcttgtggcatgcccaggcggcccgaggtcatggcgcggtcttcgccgctgtcatacaggaacacccgtggcttatcggcaggcaggttttttcgcacctgcgccacctgtgcctgcatctgcgcgatcaaggtattggcgcgctcctgcacgtcgaaaatccttcccaggttgcgcaggtcgttataggtatcgtccaggctcgcagccgggcgcttcatcacgaacgcgcatgactcggtcagctcatacacattgatgcccaagggttgcagggtgtgcggcgtgagatcgccacccacgcgcatgccgtagtcccagccggcgaagaagaaatccacgttggcgtcgagcagggtttccaccgacgggtacttgcttgccagttccggcaggccgtcgagtatggctgccatttccggtggcaccgacttccagccgctgacgccgctgtagccggccatgcgtggcttgagccccagggcgagcatcatctgggtcatgttgatgtcgtgactgaccgcatgttgcggggcttgctggaaggtcacgttgcggttgcagctctggatggtcagcgggtaacgggtggcttcggcgaacgctggggcagtggcgaacagcagggtgagcgacagcagggcgcgcaagatcatggttgggttatccaggtgattcgggggtagccggccaaggggtgagtgtcgatcaaggcttcgacgccaaacacctcgcgcagcaaggcgctggtcagcacgtcgtggggcgtgccggtggcgacgatgcgcccgtggttgatcacgtatagacgatcacagaaggccgccgccaggttcaggtcgtggatgctcgccagggtgccgatgtccaggcgcttgacgagttttaacagctccagctggtagcgtgggtcgaggtggttggtgggttcatccaggatcaacagttggggttgctgggccagggcgcgggcgaggatgacgcgctgtttttcgccgcccgagagggtgacgaaggcatggtctgcgaaatcctgcatgccgaccgattccagcgcgtgccggatcagttgcccgtcgtgcaacgtgtcgctgtcaaacaaccccttgtggggcgtgcggcccatggcgaccacttcatccacccgcaagccgaaggcgtcagggaattcctgcagcactacggcgatacgttttgcgcaccactttgcgctttgcttccagacgttctggtgttcaagcgacacatcgccatgctccggccgggtgaaccggtaggcgcagcgcagcaggctggtcttgccactgccgttaggcccgatcagcccgacaaactccccggcagcgacgcgcaggctggcgtcacgcagttggaactggtgatggcagtggtcgtgaccgggaggggtccagcccagttcgctgagggtgagtgaggtcatcagtattctcaagtccaacatagatcaacatgtgggagggggcttgcccccttccacatggggtttgtgttttattcagtcagaaggtgtagtcagcagtgacgaagaacgagcgcggttcacccaggatccactgctgcccatcgttgtactggctggccgcatacgtgcgatcgaacaagttattgagttgcaggcccaaggtggtattgcgcatggccttccacgacagcgtggcatccaccactgtgtagctcggcagttcattctggttggccatgtcggcatagcgcgcgtcgacgtaacgtacaccggcaccggcacgaacgttgtctgtcacggccttgctcagccacaggttggcggtgcggcgcggcacgtccaccgggcgattgccatcacgggaaaccggcacaccgccgacgtcctgctcgaagtcgtcatactgcgcccgcacgatggcggcgttggcttgcagttgccaggcgccgggcagttgcaggtcgaggctggcttccaggccgtcggaggattgttgaccaacttgctgcttgacgttcggctcgcccggcacgtcagtcagcagtttcttcttgacgatgtggtaagccgccagggtccattcaccgcgtgcgtcccagaacgcttgtttgataccgatctcggtctgcctggcagtggacaggtcaaactgctgctggctcggactcagggaaatcaacccgccgacgccatcggtgctggtggcgtactggccgtagaccgaggtatccggggtgatggcgtagaccaggccggctttccagttattgccggtgagggtcttgtcggattggctgccggtacgcaggtcgtcgcggtcgatgtgtgcgtagtcgcggcggatgccggtgatcagcgcgagtttatccgtgagctgcaggcggttttccgcaaagccggcgaccgtcttggtagtggtggcgaacaccggtttgaacgggtcctggctggcaaacggcgcaggcgtggggtgatgcaggtcgatgggctggccgtttttcaacacgtcattgaacggcgtattgctcgccaggcggaagcggatgcggttgtattccacgcccgccacagtctggctttcgaggccgaacaggctgtgcttgaaggtgaaggtctgtcgatcacccacctgttcctgattgtgcttgatgccgaagttgccgctgcgggtcaactggccgttggcgaagttgtagttctcggcgttctgccagcgacgctggtttttcaggtagtacagctcgttggtggcgctgaggttatcactcagttgccactcgctggtcaggcgcgtccattgatcgttgtagtgctgggtgtcgttgctgacgttgtagttcttgtcgcgcaggcccttgtgcaactggccattgatcagtggcgtgccgaagtagttttgcgggcgctggtcgccgtagtcgctggccagggtgaaactcaggttgtcggctggctgccagcgcagggcgccgctgatgaagtcgctgctggagtcgccacggtcgataaaaccgttgctgcgcaggcggttgaggttcaagcggtagctcaaggtgtcggtcagcgagccgccgctgtcgagggcctgctgctggcggtcgtaggagccgtagccgaggcggatatggttttcgatctcgcctgcgaagggttttttcgagatcgtattgaccaccgcgccggtagcgccttcgccgtacaacaccgaggccgggccgcgcagtacgtccacccgttccactgcccaggtgtccactggaaaggtcgaggtgcccatgccggtgtacatgcggttgccgtcgtacagctgcatcaccgagctctggccggtaaaaccacgggcttgcagcgaggtgccgccatccccaggcgtgccggtgcggctgatgccggtggcgcgggaaatggcgtcctgcacgctggcatcgccccgttcgcggatctgcgcgccggtctggctttccacgctgccgggggtttgcagtgccgtcaggttcaggcgcgatccggtggtggttggcgtgttcaggtcgacacgttcgtcatccaccgccggcgcggtgatggggctggcgggcagggtcagggcttgggcgttggcatgcagggcgagcaggcacaggccgctcgcaaggtagttgttcatcggtcgatcaatcgcttcttcgaggcggtgctcgccgccgggtgcggcgagctggagtatgcagaaagtgttataagttaacatttcctacgtcgtgggcgaaagcccgcgtaagactacataacgcctctatagagggcatctcacctacttcatgtcgaacctgaggccgattcacgttgcgtgaacagccgcgaaagtatcaggcggtccagcgcccacaccacaatcagcgacacgcctaccagcgggaaaacaatcgccaaccccagcatgatcaccatcgcggtcttccacttaggcaagtcatgacgcagtggcggcacacccagcccgccctgtggccggcgcttccaccagatcaccacgccgctgacagcactgagcaggatcatcaggcagatcagcagcacgatcagttggttgacccagccgaacatcttgccttcatgcaacatcaccccggtctcggtggcgcgagcgaccaggttgtagtgttgccaacgcacatcggcgaggaccttgccggtgtactggtcgatatgcagggtggcgtcattgcgcgggtcgttggcgaacaccgcgacggtgaacacgccggtggcggtggtcgggaaggtgatgctgtagccgggctcgaccttgcgtgcggtggccaggtcgaccacctgttgcaggcgtacggccggtgcggcagggcccgagtgcatggcgccatggttcatgtgttcggcgtggtcgccggacatcggcattggcgtgttttccatggcccagggcacggtctgttggctggcgctgttgagcatgcgcgcctgctgatcggattgcggcacgtcggcccacatcgccgccggaaaagtgttccacagcgcggcatattgcttgccccagaagccggtccaggtcatgccgctgagcagcatcaccagcaagaaagccgcgccccagaagccgacgacagcgtgcaggtcgcgccaaaacagtcggccccgactttgcaaacgaggccacagcacaccggccgatgacttgccgcgtggccaccataggtacaggccggaaaccacgagcatcacgccccagccggcggcgagttcgatcaggcggtcaccgagggtgccgatcatcagctcgccatgcagggcccgggcgatggcttgcaggttgtattgggcgtcctgttcaccgagtacgttgccgcgataggggtcgatgaacagcgtgacttcgcgcccgtttttttgcatgacgaactgcgcgctgctgttagcgtcgaccgggggcaggtacttgctgatcgccgcctgagggttagcagccctggcccgttgcagcagctcgtcggcactcaacgtgtgttctgcggcaggcacgttgagcaggtcggcgtacatcagcgggtcgagctggggcttgaacaggtagatgatgccggtcagggccagcagcaccatgaaaggggcgacgaagaggccggcgtagaagtgccagcgccaggccaggttgtagaaggagatctttggtgtgctcatcaggggctccgcaaggctttggtttttttgtgtcagttacaccgccatcgggggcaagtcgaatcgtcgcaccgcccctcccacatctgactgtattcacaaatcagagggtgggagggggcttgccctcgatgcttttagaagctcatatccaccttggtccagagcgtacgccccggctccttgatggcctgcgggtcgttggccgggtagccgaagccggcattacctgccaggttcaaatgctcggcgtaggctttgccgaacaggttgtcgacgcccgtgctgaccttgaagtttttattgatgcggtatgcggcgttcagcgagaacacgccaaagccaccgctcttgtcgtagtccttgccgaccacgttgcccttgttctggtcgatgcgggtttgcgccgccaccacgcgccataaagctccggcactccagtcgtcttcgctgtaggtcaggcccaaacgtgcatccagcggcggcatctgcggcaggggcttgccatcgctgctgtttttgccccaggcgtaggcgagactggcgtcggctttccagtggcgcgtcagtttgtacgctgcgccgagttcaccgcccatgatgcgcgcgtcgacattgcgcgcctgggaggtggttcccatcatgccgggccggtaatcgaacagaatgaagtcgcgcacctgaccgacataacccgaggcccaggcttcgagttcggcggttttgtactgcgcgccgaaatccagctgggtggttttctcgggcttcacgccgtcgaaggcattcgccgagccggccgtaccagtgttgggggaaaacaattcccagtaatccgggaagcgttcggcgtggcccaggccggcatagaccgtggtgggcgtgtctgccaggtcatgttcgtagcgcacgaagcccgatggcagggtgtcggcgcgggtgtcgtcggcggtcggattggggcgcgacatcatccccgagccggcgcgttgacgaaaatccttggccgaggcgcggtccaggcgcgcgccggtgatcaggcggtcattgtcggcggcgtaccaggtcagttcgccgaacacgccgtagttgtggaagttggcgtctttgttgcgcggcagatccttataggtgtcgatgcccatgctgctgcgtgcacggtgttcgttggtctgtgcatccaggccgccgatcagttgcacatcggcccagcgccaggtcgccttgatgcgcgcaccgagggtgcggcggtcgacgttggacgccatgggacctgccatcatgccggtgcccgaggggacgcgcaggctgtagttgtccatcacatggtcggcatagttgtagtagacctgggcctcgaccttatccagcacctcgccgatattggacttctcgaaacgcagcccgaggctttcgcgcaggaactgcgagccatccatgccgcggccggcgtagcgtgcctcaccatcgccacggccagcagtgagctccagcaaagtgtcggcgtcaggggtgaagcccacggccacatcgccgttccatttgtcgtagcgcgaggcgacggtgtcgttattgccgtccttgtagtcgtcggcatgggcctggttgccgatcacccgcacgtagcccaatggcccaccggcagcggcatcgatgaccttgtcgaaacgcccgttggagcccgccagcacactggcgttgacccgcgtacccagctcgccgaattgctccggctcacggtcgaacaggatggtgccggctgacgcacccgggccccagagcacggtttgcgggcctttgatcacggtcagcttgtcgtaggtttccggcgaaatgtacgaggtgggtgcatccatccgccccgggcaggcgccaagcatcatgctgccgttggtaaggatattcaggcgcgagccgaacatgccgcgcagcaccgggtcgccgttggtgccgccgttgcgtaccagggcgaagccggggatggtcttgaggtagtcgccgccatcgctggcaggcaccggttggcgtgggtctttggggttggtgacaacagtgagtggcgagctgggggcgatcgcagtgattaccgtggggctcagctcgtgttcgtgcgcatgggcgcagggggtaagcagtgcgccgcacagaacggcgaaaacaggagcagcgcccaaacgggtgtcagcagaaaacctggacatgacaaattccatcaatcaatcgtaaacaacacggccagcagcctgcggctgtctttctagagtcggccggggtgaagtaacgctgtgaaagtgtttacgcagtgatgggtggcgcgcggctgcgggcgccggggaagatgctctgccgggcatgtcccaggcgggtggcgggggtgagggcattggccggcggcggggtgccgaggctgacgtaggacacgctgccgggcagggccgggcagctgaagagcaggctgcaatagccgcacttttcccagagtacgtgatgctcgtcgggtgctttgctgggcttgggctcgccgtggcactcgggcatgtccatggacataccggcgtgatgatccatcggcatcgcttgggaaatcagcggaccgataaagatcatcagcatggcgaacaggctgatccagctgccgcgcatcaggcggcggtgtggagataacctggcgcgaggggcgcccattgaatggcggcctactgagcgtgcatgtgctcgtgtttagccattggcggcgccttttgcaccgatacttccacctcgaccttgccggctttctcgaaagtcagggtcagtgggaattgcttgccatcggtcaacaggctgcggtctttaaggcccagcagcatcacgtgataggccattggcgcgaaggtcagctcacccttggcgggtacggccacgctgggcacttgctgcatcttcatcaggtcgccttgcatcacatgctcatgcagctcggctttgtctgccactggcgtctcgacactcagcaggcgatccggtgtggccccggtgttatgaatcacaaagtacgccgcgacagtcggcgcattgggtggcaactcctgggaccagggttcgctcaccctcaggtcgccgaccttgtagtcttcggcattggcagcaccaaacactggcagcaacaacgcagccagaagcagggaagatttgagcatggcagttctccagaacggttctaaacgcagttcacttgcgaagaagatcaggccgttggagacgctcggggattaagacttggccattgctggcgcggagttggattctgcaatgaggggggaggcaggctttgcaccgcgtcgaaccgcatcacatacaactgcggcacatgccccggcagcgccaccaacggcgccgagcccgagcaacaccagcaatgctgcatggcggagtgatcgtctggcggtgccggaatctccagcttgcccaaggcaatcgtcttcaggctggcgccattggatgagcagaaactgccccatatcaggcgcttgaccgggtcatcggtctgctgcatcgcactggccaacggcatggcaaacgcattgaacagcactgcaaggcaggcgatccaggcaattgcaaagcgttgacgggccatggcggataatccgtagggttaaacgatcaaggggtatttagcctgatcgagggtgataagtaaaaaagggcggtgtggtttggtgtcgcagggttgaggatagacggggaatcgagtgggtgccggatcttcaaggcaatgcattccaaatgtgggagggggcttgctcccgatagcggcgtgtcagctactcaattgctggctgaaccactgccatcgggggcaagcccccttccacattaggtccgtgttgctcaaagggtgtgtattgcctgtagcgacgcagctacggtggtgaactctcgatctacggcaggcaacaccggccgcttcaacaccagcaccggcaccccacgctcccgcgccacttccagcttcggctcggtggcggtgctgccgctgttcttgctgatcagcacatcaattgcgcgccgttcaaacagtgcgcgctcgtcctcgatcagaaacggcccgcgtgcgccgatcacttcacaccggtcattgcccggatacacatccagcgctcgcagcgtccagaattgctcggcgggaatctcatcgagatgctgcaacggttcgcgacccagggtgaacaatggccgtttgaagggtttcaacgcctcgatcagcccgccccagtcggaaacttcccgccagtcatcccccacttgcggctgccatgccggacgccgcaacgcccagcaaggcacaccgcacaaccgtgccgcctgggcagcgttgcggctgatctgcgccgcatacggatgtgtggcgtcgaggatcaggctgatacgttcatcgcgaacaaactgcgccaacccctcatgaccgccgtagccgccgacacgcacctggcaggtaaggtcggtcggcacacggcccacgccggccaagctgtagatatgctctggccccaaggtacgggcaatggccagcgcttccgttacgccaccgagcagcagaatccgtttcatagcggcttgaccacttccagcagggtgatcggcagcgcctggcgccaggtatcgaactcgcccaatggctgcgcctgggccacatggatgcgggtcagctcgccgccatgctcggcgcgccaattcatcaaggtcatttcgctttgcagggtcacggcattggcaaccagtcggccaccgggacgcaggtgctgccagcaggtgtcgagtacgccctcacgggtgacgccgccaccgatgaagatggcgtccggggcttccaggccaagcaacgcatccggggccttgccgcgaatcagttgcaggccgggcacgccgagggcgtcgcggttgtgttcgatcaggttttggcggcccgcatccgcttcaatcgccaaggcgcggcagctggggtgggcgcgcatccattcgatgccgatggaaccgctgcccgcacccacatcccacagcagctcgccgggcatgggggcaaggcgggcgagggtcatggcgcgcacatcgcgtttggtcagttggccgtcgtgcttgaacgccgagtcgggcaggcccgcaaggcgcgacagatgtagagtgttggcatccgccaggcagtcgatggcgaccaggttcaagtcggccaccgaagcctgctcccacgactgcgccaacccgtcgatacgccgttcgtgctcgccacccaggtgttcaaacacgctcaatcggctgggcccatacccagcctcaagcaatagcgacgcaatcgcagccgggctgctgccgtcattgctcaacaccagcaaacgcacaccactggccagatgcgcattgatcgccgcgattggccgggccaccaccgataacgtcaccacctcctgcaacggccagcccaaacgcgccgccgccagcgacaccgaagacggcgcgggcaagatcaacagttcctgcgccgtcacctgccgcgccaggctggcgcccacgccatagaacatcggatcgccgctggccagcacgcacacagcctcgccacgtcgcgacagcaccggttccagggaaaacgggctcggccacaattggcgctcgccacggatacacaccggcaacaggtccaactggcgctgcccgcctataatccgcgaggcgcgcaacagggcatgccgggcattcctgcccaggcccttgaagccgtcttcaccaatgcctacaaccgtcagccagggcgacatatcaattccttgaacgacatccgacgggcaggcttttcatgccgccggacaaagcaggcataataccgcgcctttacccgtcaaccggtagccccgtgaacccaacgcccgctgtgaataccttgcgcccctcggcttgtccggggttgctgcgtattgtccaggcgttggatggcggcatttgccggatcaaattggccggtggttcgatcagtgccgcccaggcccatgccgtggcggacgcagcccaggcctatgcgggcggagtgatcgaggcgaccaaccgcgccaacctgcagatccgcggcatcggcgccgagcagcaggccctgatcgccatgttgctggcggccgaccttgggccgagcaacgccgcgggtgacgacgtgcgcaacctgatgctcagtcccagcgccggtatcgacccgctgatgctgttcgatacccgcccgttggccgcgcagatcctcgccaccctgcaaacccatccgcgctttcatcaactgtcggccaagttcgccgtacagctcgatggtggcgaagccctggcgatgcttgaacatcaccatgacctgtggctttcggcgttcgtgcgcgatggccagacgctgttggcattcggcttggctggctgcccggggctggatgcgcccgtggcggcggtgccgttggaccagggccatgccttggtggtggcggtgctggaagcctttctcgacctggcgacgcccgagcaaacgcgcatgcgccatctggctgtggataacgtagtgagccgcctgggcctgccgctgctgccggcggagggcttccagcgcccggccagtggcgcgctgctgcacctgggaagttatccacaggcgcagaaaaaccagttctacgtcgcggccgtcgcaccattgggccgcctggatccgttgatgctcaagggcgtcgcgcagctggccagcgagtacggcgacggaacgttgcgtttcacgccctggcaaggggtgttgctacccaatatcgaacgccctgtcgcggtgaccgaacgcttggcgcagttgggctttctctgctctatcgaccaacccttggcccgcatgatcgcctgtaccggttccagcggctgcggcaaaggcctggccgataccaaggtcgatgcggtgcaattgtcggccctgcaacccggcgtcgaggtgcatctgtccggctgcccgcgctcctgcgccgcggcgcacaccgcatcggtcacattgctggcggtgagtcccggccactacgacctctattttcgcgacgcagcccaacccggtttcggccggctgcacgcgcgcactctttccattgaagcggcgggcgccttgctgcgcgctcgcccacggagcaacaccgatgattgattacatccgcgacggtcaggagatctatcgcaactccttcgccattattcgcgcggaagccaagttggagcgcattccggctgacttggaaaaactcgcggtgcgggtgattcatgcgtgcggcatggtcgaggctatcgatggcctgcaattctccgcaggcgcaggcaaggccgggcgcgatgcattggccgctggtgcaccgattctgtgtgatgcgcggatggtgtccgaaggcgtgacccgtgcgcgcctgccggccaataacgaggtgatctgcaccctgcgtgacgatagcgtgccggagttggcacgcacactgggcaacacccgctccgccgccgccctggaactgtggcgaccgcacctggaaggcagtgtggtggtgatcggcaacgcgccgaccgcgttgttctacctgctggaaatgctggatgccggcgcgccgaaaccggcattgatcctgggttttcccgtgggcttcgtcggtgccgccgaatccaaggcgatgctggcggcggatagccgtggcgtcccgttcgtgatcatgcagggtcgcttgggcggcagtgccatggccgcagcggcagtcaatgcgctcgccacggaggtcgaataatgcaggcacgcggacgtttgatcggcctgggggtaggccccggcgacccggaactgattaccctcaaggccctgcgcctgctgcgtgaatcgccagtggtggcgtacttcgtcgccaagggcaagaagggcaacgccttcggcatcatcgaagatcacctggtcgcgcagcaaaccctgatgccgctggtgtacccggtgaccaccgaagtgctgccggcgccgctgtcctatgaacaagtgatcagcgacttctacgacaatgccagccttgatgtggcggcgcacctggatgcgggccgcgatgtggcggtgatctgcgaaggcgacccgttcttctacggctcctacatgtacctgcatgatcgcctcgcagagcgctacgaagcccaggtaattccgggcgtgtgttcgatgctcggtggcgcctcggtgctcggtgcgccgttggtgtatcgcaaccagagcttgtcggtactatcgggcgtattaccccatgatgacctcaagcgccgcctggcggatgccgacgccgcggtgatcatgaaactggggcgtaacttcccgaaggtgcgccaggtgttggaagaactgggcctggccgggcgtgcgctgtatgtggagcgcgccaccatggtcaaccagaagatcgtgccgctggatcaggtcgatccggcgtcttcgccgtatttctcgctgatcatcgtgcccggtgaaaggtggcaaggttgatgactccggcgattgtgattctgggccaaggcagcttggccaccgcacgcaagatccaacaggtttacccaggcgcgttgatccacggtctggctggaagggtggacggtgcagaccaggtttacagcgagttcggcgcgacgttgcgccagctctaccagcaaggcacgccgctgattgccttgtgcgccgccggtattgtgatccgtaccctggcccctctgctgctggaaaaaggcgaggagcccggcgtgctggccgtggctgaagatggcagcgctgtggtgcctttactgggcggcctgggtggcgtgaatgtaatggcacgggacatcgccgcggcactgggggtatccgccgcaatcaccaccagtggtgagctgcgtttcggcacctgcctgctcaacccgccggcgggttatcagttggccgacattgaactgggcaagggctttgtctcggacctgctggctggcgaaagcgtgcgcatcgaaggtgacgcgccgtggctggaccaggccaacctgccacaggaccagcaggcgcgcctggcgattcacgtgggcaatgccgagcgcatcccggcggccaatgaactgctgatttacccgcgcaatgtctacgtgacctgcaagcccggcgagcagttggtcgaacgtgtgcgtacggcgttgcatgaagcgggaatcgccgtgcaagccctggcatgcctgttggccagcgacctgcaaatggccgaaggctcactgcatgaggcagcgttggcgttgggtgtgccgttgcgttttacgcaggtgaccccagttgcggatatcagcatcaccgtggccgagcagcccttggatctgtcacaggtggggcgcccccgtggccgtctcgccgtgatcggcctgggcccgggggctgccgagctgatggtgccggcggtcaaggccgaactggcgcgttgcactgacgtgctgggttacgaaacctacgtgcgcatggccgggccgttccgtgaagatcaggtgcaacactgcactgacaaccgcgaagaaatgcagcgcgcacgccacgccttcgagctggccgcgcaggggcgttcagtggtggtggtgtcgtccggcgacccgggcgtgttcgccatggccgctgcggtgatcgaggcgctgcacgaatccggcgacccggcctggcatcaggtcgacctggaaatcctgccgggggtttccgcctccctggccaccgccgcccaggccggcgctccgctgggccacgacttctgcgtgatgtcgctgtcggacaacctcaagccctggtcgatcattgaaaagcgcctggacctcgcgtcccaggctgatctggccctggcgttctacaacccgatctcgcgctcgcggccctggcaactggggcgtgccctggagatcgtcgcgctgcatcgcacaccgcaaaccccagtggtgctgggccgcgacatcggacgccccggccagacgctgcgcgtcaccacgttggggcaattgacgcccgagcaggtggacatgcgcaccatggtgctggtcggctcgtccactacctgcacattcccgcgtgccggtggcggtgagtgggtgtacacaccgcgctggtacggcgaaaaacccgtcagctgaaaacgctccattggctgccggaaagctccgaatgacccagggatttacctggcgttgtccggagctttttcttttttatgcgatgaaaaccgcaagtcccgtgcccgccccctgtcattgctggtcgatggtttttagtgggtgcggccaaggaatgtttgtcccatggaaaaccctccctgcactggactagggtgcaagtaagccccatgtgggggtgcttgtggagaactggaaatggagcgacgtcacagaaggatcaacagtaaaaaaaggcgcaaattgattgccgcctacaaactgccgggagcccctggcaagcagctcgcttcaaggttggatcgcgaggacgactgcaatgcggcggtggtcaacaacagtgtgatttcgtttgccgaggggctgtctgcgctgaaccgcgagtacattcgcaaaagctacctgctggccagcagttatgtgagcgatgtgttgaaggtccaacgggggaccgaggcgtggtacgacgaatttatcaaggtcatggtcagtctgggttggttgccggtgcgcagtcgttttgagcgggtctcgcgtgcgggcaagggcctgacggtgcaactggcggccctgaatatcatcgctgcgatgctggcgtcgacgtcgctgtcggggccattggtcagcgccttgccgaagttggctgcggatgcactggaagcgttaaagcagcggccggcgtgtttcgatctgttcaagcgcaacacgacggtgcaggagggcggcgattttggcctggcttcctgtaccgaaaacaacggtgaactgatgatggtgctggtgacctacagcacccacggcgtggataaacacctgggcgtgcccttcctggagtgggacagctcgtcgttcgaggcattcagcgggcagacctgcctggtactgaatacctcggtggtcaatgaaaaaaccatccagctgatgcgtgaaagcgccggcgacaaagtgcaactggccattgccaagtaccggatctaaggcaccaggtagccgcgtacaccggtaaaaattatttgtgcggccagggcgcagacgaacaagcccatcaggcggctgacaatctgcaagccctggtcgccgagaatgcgttcgatacggttggacaggtacagcaccacacccaccgtgaggctggccagggcaatgctgagaatggcggtgagcttgtcatcccagtgcggttggctgacgcccatcaccagcaatgcgccgatggtgccggggccgacggtgagggggatggtcagcggcacgatggtcacatcctgctgcacgttgtcggtctgcaccgctgacttgccttgggccatgcccagggcggaaatgaacaacacactgccggcgccgatgcggaatgcgtccacggtaatgccgaacacactgaaaatcacccgaccgaacaggtagagcagcacgctcgataccagggtcgccagggccaccttccaggccaggcgccgacgttccttgctggaataaccacgggtcaggctgataaagcaggacagcacgaagaacgggctgtagagcaccagcattttcaggtaaacgctgaataacacatggagcatgggggtggctcgcgggcggtggaagtgtgggcagtctatcaggcggcagagatcaaatgtgggagggggcttgcccacgatagcgctgtgtcagtaacaaatatgctgactgacccactgctatcgggagcaagcccgctcccacatttgatcgcattttagatcatgagggcgcatgttccggacgctgttggcgctgcgctacccaatagtccaccagctcacgcaactgcgacaactccaccggcttggccatatgtccgtccatgccggcctggcgtgcgcgctccttgtgttccgagaggatatgcgcggtgagcgccaccactggcgtacgtacgcgttggtggctgacttcccacgcccgcagttgctgcgtggcagagaaaccatcaaggatcggcatctcacagtccatcaacaccaggtcataacgctgggctttcatcgcttcgagcgcttcttcgccattgctggcggtgtccgggttgaggttgagcttgccgagcatgccgcgtatcactttggtggagatgctgttgtcttcggccaccaggatgcggaaatcgctgggcacgctcacggctgccggtgcgctggggaccgggcgtggaaaggccgcgcctttgctgcgctgggtcagttcgtcggccagggtggtcttgagggtataaccggccaccggcttggcgaggatgcgcttgatcccgcaattacgcgcaatgattttgctcggcgcgttactgatgccggtgagcatgatcagcaggatgtcatggttcaggctcgggtcttccttgatcttcgccgccagttgcatgccggtcatgccgggcatgttctggtcgagcagcaccacgtcgaagtaatcgcgcaggtgcgccttggtgcgcaacagggccagggcctccttgccggaaggcacggcgctgacgttcaggccccaggcggtacattgctgtaccagcactttgcggcaggtgtcgttatcgtccaccaccagcacgcgcgcgtccttgagtgggccgtcgaggtcggaggtcgggtgttccaggcgttccgggtccagcggcagggtcagccacaaggtgctgccctgatgactgccgctcttgataccgaactcaccgttcatcaacaggatcagttgacgagcgatcaccaggcccaggtggccgctcaagcgcgtcgccgagaggaagttcttgctgtgcagttcactgtgcagcagggcgtcgcgttcggcggcttccatgggcaggccgctgtcctgcacggcaatgcgcaggcgtggcttggtgctgcgctcgtccagggcgacaacgatcagtacttcgccttcatcggtcttgtgcagggcgttttccagcaggctcagcaatgcttggcgcaggcgcgtcgggtcaccgctgatcacccgcggcacctggggctggataaagctgatcagctcgacattctgctgctcggccttggcgcggaagatactcaggcagtcgtcgatcaacgcattgaggtcgaattgcacatcatccagttcgatctggccggactcgagcttggagatatccaggatctcgttgatcagggtgagcaattcgttaccggcactgtggatggtctgcacgtagtcgcgttgcttgaccgacaacggcgtgcccagcagcaattcggtcatgcccagcacgccgttcatgggcgtgcggatctcgtggctgatcttcgccaggaactcggccttggcggcgatctcggcgttgctggctgccaggtcgcggctgaggctgaagcgggtttcgacaatcgcgcgttggcgctcgccaagggccaggctcattagcaggccgctgatgcagataaagcccagcagggtgacgatcaagccttgcggcgccaccagtgtcaggccgagcagggcgggcaggatgatcagcgtgccgatgttgaacaccaccatcgccgccacgaacaggcgcgccgggcggtagccttgctgccagtggtaggccgagacaaacagcatgctcaggccggccagcgccacaagtgcataggtgatgatattcagtggcagggtattgacgaacaacagcagcaagccggatagcacgatcagcagtatgtcggccatcagcagtttgttcagtgggtgcgggcccaggggcatgaagaagcggtaggcaaacatcaagccgcagggggcggtcagcagcagggcaaggtatgcgccgggtgtctggatcgcatgccagttcggcagccatggccctaccaggttgaggagcagcgccaggctgagcatcaacaggagttcacaggcggccagccacaggctgctgcgcgagcgatggtaggcgaagcgcgtgaggttgtgcaggatcaacatcagcagcacgccgaacagcaagccatagatcagtgtctggttctggttggcggcagccagtacggccggttccagggtgatgtaggggcgcaactcgtgttccgagaccagccgcaggtacacctcaagggggcgcgggctctggggcatcggcagcatgaagtcgctgctgggcagcgggcgttcagactggggctggcgcgtgccggtggtctgttgctctaccagggtgtcgccgtccagcacatacaggctcaggctggacaggtctggcgcaaagacccgcagcacttgctcgtgcttgcccggttgcagcctgaagcgcacccacagcgcaccgtccggctgcgcggcagtgatccggtccagttcgatggggctgaattgattggtgtagcgggcggaacggatgtcgctcagttgcaggtcggcctgttcgtcaagcaatactgcccaaccactgccttgcgcggcggcctgggccgggaacaagcagagcagggtcagcagactgacggtgaaacctatggcgatcctgagccagcgcacggcgaaatcccttcgtaggttgattgcacgggttaactatgcgcggggcgacatgtgtacggcaagggccagaggcccttacctaaccgaacggatagctacttgaagtgtagctgctcagctgttctcaccacgttcacgggcaatggcgcggtagccaatgtcagtgcggtagaagcagcctttccagtcgattttcgcggccagcttgtacgcctgctgttgcgcggcatcgacactggcacccatcgcggtggcacacaacactctgccacctgcggttacaactttgccgtccttgagcacggtgcctgcatggaacactttgccttccaagccagcggccgcgtccaggccttcgatcacatcgcccttggcataatcggcagggtaaccgccggcagccagcacgatgccgacgctgggacgtgggtcccattgcgcttcgaccttgtccagcgcctgggccagtgcagcttccaccagcagcaccaggctcgattgcaggcgcagcatcaccggttgggtttccggatcgccgaagcggcagttgaactcgatgactttcgggttaccggctttatcgatcatcaagccggcgtagaggaagccggtgtagacgttaccttcgtcggccatgccgcgcacggtcggccagatcaccaggtccatgacgcgttggtgcacttggctggtcaccaccggcgccggggagtaagcgcccataccgccggtgttcgggccgctgtcgccgttaccgacgcgcttgtggtcctggctggtggccattggcagcacgtttttgccatcgaccatcacgataaagctggcttcttcgccgtcgaggaactcctcgatgaccacacgggaaccggcgtcaccaaaggcattgccggcgagcatgtcgcgcacggcgtcttcggcttcctgcagggtcatggcgacgatcacgcctttaccggcagccaggccatcggccttgatcacaatcggtgcgcctttttcacgcaggtaagccagggcaggctcgatctcggtgaagttctggtagtcggcggtggggatcttgtgacgcgccaggaagtccttggtgaaggctttcgagccttccagctgggcggcaccggcagtggggccgaaacaatccaggccccgactgcggaacaggtcgacgacgccggccaccaatggcacttccgggccgacgatagtcagggaaacgttcttctcggcaaagtctgccagttgctccagggccaatacgtcgatggcgacgttttcgcacttggcttcgatggcggtgccggcgttcccgggggcaacgaagactttctggacccgtgggtcctgggcgactttccaggccagggcgtgttcacggccaccgctgccaatgatcaaaacattcatttcaaaaacctcagagaaacgctgtgcttctctgtaggagcgagcttgctcgcgaagatcgccaacgatgacgaggggaaactgacaccccgtggcgtttttgagtttttcgcgagcaagctcgctcctacagtagagaagcggtgctgttagtggcggaaatgacgcataccggtgaagaccatggcgatgccggcttcatcagccgctgcaatcacctcggcatcacgcatcgaaccacccggttggatcacggcggtcacgccagcttttgcggcattgtccaaaccatcgcggaaggggaagaacgcgtcggaagccatgaccgaacccaccacctgcaaaccggcgtgttcagccttgatcgcggcgatacgcgccgagttcacgcggctcatctggccggcaccgacaccgatggtctggcggttcttggcatagacaatggcgttggacttgacgtacttggccactttccaggcgaagatcaggtcgttgatctcttgctcggtcggcgcgcgcttggtgaccactttcaggtcctggctgccgatcatgccgatgtcgcggctctgtaccagcaggccgccgttgacgcgcttgtagtcccaggcagctgcgcgctcggctgaccactcgccgcaggccagcaggcgcacattggccttggcggcgacgatggcgcgggcttcttcactgacgcttggggcgatgatcacttcgacgaactggcgctcgacgatggccttggcggtctcggcgtccagctcgcggttgaaggcgatgatgccaccgaacgcagattcggtgtcggtggcgtaggccagttcatacgcctggcggataccgccctcagcgtccgggctgacggcgacgccgcacgggttggcatgcttgacgatcacgcaggccggcttgacgaagctcttcacgcattccaacgcagcgtcggtgtcggccacgttgttgtaggaaagttctttgccttgcagctgggtcgcggtggcgatgcccacttcggcaggcttggcttccacgtagaacgccgcgctctggtgcgggttctcgccgtagcgcatttcctgggccttgatgaactggctgttgaaggtgcgcgggaactggctgcgatcttctgtgctcagggtgtcagccgcctggttcacggtgcccatgtagttggcgatcatgccgtcataggcggcggtgtgttcgaacgccttgagcatcaggtcgaagcgctgggcgtaggtcaggccaccggccttgaggctttccagaacctgggcgtagtcgccggcgttgaccacgatggccacgtccttatggttcttagcagccgagcgaaccatggtcgggccaccgatatcgatgttttcgatggcggtcggcaggtcgcagcctggcttgttgatagtggcttcgaacgggtagaggttgacggccaccagatcgatcggcttgatgccgtgctcgttcatgatggcgtcgtcgatgccgcgacggccgaggatgccgccgtggattttcgggtgcagggtcttgacgcgaccgtccatcatttctgcgaaaccggtgtagtccgccacttctactgcggccacgccgttgtcctgcagcagtttgaaggtcccgcccgtggagagaatttccacacccagggcttccagctcccgggcaaattcgaggatcccggtcttgtcggaaacactgatcaaggcgcggcggatcggcaggcgggtagtctggtcggtcatttcaatttccatcaaaagcaaaggagtcagcaaaaaaggcgaccggttttacgcgggcgcctttctggtttgattgaatgcttacagcaaatcgtactgcttgagctttttgcgcaaggtcccacggttgaggcccagcagctcactggctttggtctggttgcccttgacgtagttcatcacgctttcgagcaagggcgcctcgacttcggagagcaccaggttgtacacgtccgtgacggaagcgccctcaaggtgggcgaaataattgtgcagcgccttctcgacactcccgcgaagggtctggccttcttcgctcggcgtattgaggtgctgtttcaaattgacgttgtcgctcacgggtgttgttccactcactaaagtctcggtcatcgtcgtcatgcggccaccccttctccatcccctgttcccaggctcttgtcacgttcggcaaaaaactcacgaacggtggcgacctgtgcctgcgtttcatccaaacgattgaactgggcgcggaattccttggcgcccggcaaggtggcgagataccagccgacatgcttgcgagcaatgcgaacccccatcacatccccatagaaggcgtgcagggcggccagatgctctagcagaatatgttccacctcgttcagtcccggtgccggcaatacttcgccagtacgcaggaaatgctcgatctcacgaaaaatccacggtcgcccctgggcggcccggccaatcaacaaaccatcggcgccggtcgcgtgcagtacgcgctgggctttctcggcggagtcgatgtcgccattggcaaataccggcatcgacacggcctgcttgatcgcggcaatggtgtcgtactcggcttcaccggtgtaaaggtcggcgcgggtgcggccatgcaccgccagcgctgtaatacctgcctgttcagcgatcttcgccacggtcaggccattcttgttgtcccggtcccaaccggtacgaatcttcagggtcaccggcacatccactgcggcgacaacagcctgcaggatctcggcgaccaactgctcatccttcaacaaggcggaaccggcggccttgttgcagaccttcttggccgggcagcccatgttgatatcaataatttgcgcacccaactccacattggcgcgggcggcctccgccagcatctgcgcgtcacccccggcgatctgcaccgagcgtggctcgggatcaccttcgtggatcatgcgcatccgcgacttgcgggtgttccacagactcatgtcgctggtaaccatttcagagactactagacccgcgcccaaacgtttgcacagctgacgaaagggctggtcggtgacgcccgccatcggggcgaggatcaagccgttctgcaatgtgtatgggccgatgcgtaccgccgacataggacttccctgttgtggggccggatcattagagttcgaaaaagggttggcatgatacccgctctcgatgactggttaaaggctgaattggataaaatctgaacagttgcttttttattgccatcggtttggtcgatggcgcaaaagtcaataatccgccgtcaaacctcgacatatgcgccggttcactcgggcgaatggaagctcaggctgtagttcacggctttgttacctgggtcgagtatgtccagggagatgtggatcggcgtctgtgaaggcatttcgctgacgccggccaactcaccgctgaggtattcggcaggtttgaaacgacgactggcaatcaggctgccgttcaagtccgcaaagcgtagttccagcagtgggaagggctgggagaaggtcgcacggttatagatgatcgcatccaccaccagcgccccggcgaactccggatggctgcgtaccaccaggttgctgctcttgatatgggcaatatcgacccgcgatggcacggtacagcccagtttcgggcacagttcctggaaccacggacggtaggcgtcctgacgagccagttcgtcgaattggtaggcaatgtactggcctgccagggctgcggcggcgagcactaccagcagtatccagatcaagcggcggccccagcctgacggacgtttctgcgcatacaagtgcagcggatcgtcttccaggtcctggagcaggtcgtcgtgtaaggcgacttctgggcgcgggcgtttgcggcgtgactgtgggcgctcgtcggattcaggctcaccttccacatcggtgacaggtgtcagcggcgggtcgcggtcgtcatcgccaggggcggcgtccagccgcggctggtcgccgaggtcgtcggtatgggccgacatggatggttctgtgcgctgtttggatgcgggtgccctggtcggctctgccaggtcttcaggtacctgggcccgctcctcgggtggttcgctgaacaggctggcagcccatttttcttcttccgccttgaccgtattgcggctggcactgaaggactcttccttttgccgacgctcggcgcctggttggcgacgttccgcacccaatgcctgggtgtgctggatctcgcgacgctccagcttggccagttcctggtcaaggtccaggttgtccaggtccagcgcttgggccgcccattgcttctggctgattgcctgcgctggctcgggtgtcgcttcgacagtcgatctatcggctggctcgtcgtcagccggcagctccggttgcggtgcaggcgcatgggcgcgttgctcgagcaactggcgagcggcgttgaacacttgcaggcacgagccgcagcgcaccacgccacgggccacgctcaactgggcatggttgacgcggaaacgggcttggcagtgcgggcactgggtgacgaagctgtcggtcatgcggtcatccgattcaggcaagcgctcattctagcgccgacgaccactgatgcgtacccagccatcacggttggcgatcgggtccagttcgaagtcctgggcgtaggctgcggcgacatcttcaccttgttcggcgaggatacccgacagcgccaggcggccgccgggcttgaccaggctggacaattgcggcgccagggcaaccaatggcccggcgaggatattggcaaccagcacatcggcctgtacctgcggcagatcctccggcaggtagagtgggaatttgccttcggggatttgattgcgcccggcgttatcgcgggaggcttccagggcctgcacatcgatatcggtgcccacggcctccttggcgcccagcagcagggcggcgatcgccaggatgcccgagccacagccgaaatccagcacattgcagtcggtcaggtcctggccgtccagccattccaggcacagggcagtggtgggatgggtgccggtgccgaacgccaggcccggatccagcagcaggttgaccgcctcgggttcaggagcggcgtgccagcttggcacgatccacaggcgctggccgaagcgcatgggctggaagttatccatccagctgcgttcccagtcctggtcttcgatgacttcgctgtgatgctctggcagcggcgcgccggtgagcagctccatatgggccagaacgctggtggcttcggtgccgtcttcgaacagggccagcaaatgggtgtgggaccacagcggcgtggtgttgagttcaggttcgaagatcggctggtcttcggcatccatgaaggtcaccgatacggcgcccacttcgaggaacgcgtcttcgtaggtttcggcttgttctgggctgatggcgagacggacttgcagccaaggcatggcgggcacctttgaaaaaaatgaatgtgcagcgagtaggccgcgaaagcgcgcaagtttacgcgagcggacggcagaagacgacattactgaatgagcgcggaccaaatgtgggagggggcttgctcccgatagcggtggatcagttacagatactgaggctgacacactgcaatcgggagcaagccccctcccacatttggacagtgtccatcctggaaaacaggtgtgcagaaacaacaaaaccgcccgaaggcggctttgttgggtggagcacttactggttggccagcttgtgttccaggtagtgaatgttcacaccaccttcgcagaagccttcatcgcgtaccaggtcccggtgcagcgggatgttggtcttgatgccgtcgaccacgatttcgtccagggcgttgcgcatacgggccatggcctcgtcgcgggtggcgccccaggtgatcagcttgccgatcaacgagtcgtagttggacggaaccttgtagccgctgtacaggtgcgaatccacacgtacgccgttgccgcctggcgcgtggaaatgcttgaccaggccagggcttgggataaaggttttcgggtcttcggcattgatgcggcactccagggagtgaccgtgcatcttcacgtcgtcctgggtgaaggacagcacgttaccggcggcgatgctgagcatctccttgacgatgtcgataccggtgaccatctccgataccgggtgctctacctgcacacgagtgttcatctcgatgaagtagaaacgaccgttctcgtagaggaactcgaaggtgccggcgccacggtagttgatgtcgatgcacgccttgacgcaacgagccaggacttcctggcgggctttttcgtcgaggcccggtgccggggcttcttccaataccttttggtgacgacgttgcagcgagcaatcgcggtcgcccaggtggatggcgtggccctggccgtcggacagtacctggacttccacgtgacgtgggttggtcaggtatttttccaggtagaccatcgggttgccgaaccaggcgcccgcttcagagcgggtttgcttggcggcttcgatcaggtcttcttccttgtgtaccacgcgcatgccgcgaccaccaccgccaccggcggccttgatgatcaccggataaccgacttcgcgaccaatgcgcagggcggttgcctcgtcttccggcagcgggccgtccgagcctggaacggttggcacgccggccgcgatcatggcgtccttggccgacaccttgtcgcccatcaggcgaatggtttcggctttcgggccgatgaaggcaaacccggatttttccacctgttcggcgaaatcggcgttttccgcgaggaagccgtagcctgggtggatgccatcggcgccggtcacttcggccgcggcgatgatgttcgagaccttcaggtacgagttcgcggccagcggcgggccgatgcagatgctttcgtccgccagtttcacgtgcatcaattcggtatcggccgtcgagtaaacagcgacggtcttgatgccctcttccttacaggcgcgcaggatacgcagcgcgatctcgccgcggttggcgatcaggactttttgcagtttcttcgcaggtttcaacatcgaaggtgctccgcggttcaaacgatggtgaacagcggctggtcgtactcaaccggctgaccgttttccaccaggatggattcgatgacgccggctttttcggccgtgatgtggttcatcatcttcatcgcttcaacgatgcagatggtgtcgcccactttcacggtcttgcccacttcaacgaaggctggcgaggtcggtgccggggtgcggtagaacgtaccgaccatgggcgacttgaccacgaaaccgttcagcgcaggtgcggccggagcggcaggtgcagcagcggcgggtgcggcggcagcaggggcggcagcggctggagccggtgcttgcatctgcggcgcgtagaactgttgggccggggtcttgctgtgacggctgatccgtacggactcttcgccttccttgatttccagctcgtcgataccggattcttccagcagttcgatcagtttcttaactttacggatatccatgaatcatcaactcccaagggtcggtcaggggcgcttggcctgttcttcaagctgttccagggcggcctccagggccagtcggtaaccgctggcgccaaggccgcagatcactcctaccgctacgtcggagaagtaagagtgatggcggaaaggttcgcgtttgtacacgttggacaaatgcacttcgatgaatgggatgctcaccgccagcaacgcgtcacgtaatgcaacgcttgtgtgtgtaaaagcggcgggattgatcagaataaagtccacaccttcgccacgcgcggcatggatgcgatcaatcaattcgtactcggcattgctttgcaggtagagcaaatggtggccggcaacacgagcccgtttttccaggtcaaggttgatctggtcgagggtcactgccccgtagacgcccggttcgcgggtgccaagcaggttcaggttgggtccgtgaagaaccagtaaggtcgccatcggctgttccttgttatgggtgtgggtgcggcagaacccggcgactatgccgcaaagcctttgtgactgtccagttctatgcagtaggcagcacgattagcgaggattgcgcaaaatttgtgactgcggcccaagatgcagtcatgcctgacacggtcttgaatccactgaagatcaaatgtgggagggggcttgctcccgatagcggtggatcagctacgggtattgagactgacacactgtaatcgggagcaagccccctcccacatttgatctccatagggcgggagagcgggtcagacgcggaaggcttgtacggcagtgttgagctgcccacccagcaccagcaggtgttcaccctggctgcgcccctgcccgatacgtagcaggttgtcctcacctaactgatgaatccgctcactgttatcgcgaatctcactcacggccccactctgctgcgcggtcacatcggcgatgcgcaccgcagtctcggaaatcgtctggatcgccccgacgatttcatccagcgcgccatccgccgcctgggcttgctgggcggtggcttcggcgtgttcgacctgggcacgcatgccttgcaccgattgatgggcggcggtttgcaggccggcgatcaggccctggatttcggcggtggcgccggcggtgcgttgggccagggagcgaacctcgtcggccaccacggcgaaaccacgcccggcttcaccggcacgggcggcttcgatggcggcgttaagggccagcaggttggtctggtcggcaatcgagcgaatcaccgtaagcacaccgccgatggtggcggattcttctgcgagtttctcgatcatctgcgcattttgctgcacttcacccaccagggcatgcagcccggtcaggctcaggcctatcacccgctggccttgctccaccgcctggccggcgctgcgactggcgccggcggcctggctggcatcaccggctacctgctggatggtggcttccagttcgcccagggaatcacggatctgcgcggtgtcgccggcctggcgttcggcgccgtcgtgcaggccgctgctcagttcggccagggcgcggctgctgccggcgacttcttcggcgttgccacgaatggtgcccaccaggtccaccaggtaggcgcgcaaacggttgagggaggcttcaatagcgtgcagttcacggttggtcctgcccaaggcaatgggctggctgaagtcgccttcggcccaggtagacaaggccggtgccaggttggtcagtacgtgagccaggcggcgttgcagggtgtcgatcagcagggcgatcagcaggatcaggccaatcataacgccctggatgacgcgtacttcgccctggatcctggcgtgttgcgcgcgcaccaccggctccaggccggcgatggcttgctgcacgctggcgattttcagctgggtgccggcggcgaggtcggcgcgttgctggatctgctcgcgggtgcgctggagttcggcagggtagcgggtcagcaggctgttgagttcgcgcttgaggtcgacgccagtgtcctgggcttcggttttttcggtgttttccaggcccatcagtgcagagaaatcgtcggtgttggattcggcgctggcctttaccccaagcaacggcaattgccccagcaggtcggcttgggtgcggatattggcgatctctcgttccacctcatcggccagctcggcgcggccactgctcaccagcttgtcccgggccagggacagcttgcccagatgctgcgaggcggcgagcagcgctggcaggtagcgcgctgcatcggcgctattgacgctgctggcgtattggctcagttgctccaggtttgcccccagttcgcgttcggcctgcaacagcagcgcttgcgggtcgccggccagtttgccggcggccagaaggtctgtcttgctgaaggtttccaggtccgccaggctggggcgcagggtttgcgccagctcggccggcagctcggcgagttgctgcaacaggctttccaggctctggctggcagcgctcaggcgcagggcatcgccgctggccaggtagtcgtcgatattacgtgcagcccggttttgaaacacctgggacaggcccaggtagcgctccatcaataaatacggacgctccagcgcccgttgcgaccaccaaagcgtcgcgccgagggccaggcaaacggcgaccagcagaagggtattgagattggtcagcagcttgaggcgcatgcagggtttcaaccgacggcaaaagataagtgcctgaagttattgcgcctgcgttacagagttatgaccgattcggtggattctggtgaaaagatggcactttgctttgatgtgcgagccgcttgtacacggttacgcccggcgcccttggcgcggtacagcgcttcatcggcctgagcggccatcatcaggctgtcggagtcgtcgcacagctccaccaggccggcgctgaaggtgcaccacaaatcctggggttgggcggggtagtggatttctgcaaagcgcccgcggatatcgtccagcaccttgcaggccgattccaggtcggtgtcgggcatgacgatggcgaattcttcaccgccataacggcctatatagtcggtcttgcgcagacgctgcttgagaaacagcgccaggctcttgatcacgcgatcgcccatggggtggccgtggctgtcattgacccgcttgaagtggtcgatatccagcatggcaaagctcagcggcttgttttcgcggcgggcgcggaagctgcagtcttcgagcaattgcaggatatgcgtatggttgtatagcccggtcaggctgtcgcgcaccatccgtgccttcaagttacgcgcacgcgctgcgcggttgcgcacggtggtgatcaggtggcgcggcttgatcggcttggtgaggaagtcgtcgccgccttcactcatcgcgtccagttgtttatccaagtcgtcttcggccgacaggtagatgatcggcacgctgacatagcggtcgttatggcggatcaccttggccagttcggtgccggtacaggcaggcatatacatgtcgaggatgatcaggtcgggctggaaatccgccagctcggccatggcctggatcggttcgatcaaggtgcgggtgacaatgccggcgctgttgagcaggcgttctgtatgcagcgcctgggcccgcgagtcatcaatgatcagcaccttgtacggctcgtactgggcaatgcacgtgagcacttcgatcttttccagcaggctggaggcttccagggtgccggtgaggaattcctcgccgccagcgcgcacggcggccaggcgtgtcggggtgtcggtttcgtgcaggctgaaaaacagcagcggcagcttttgttccaggccctcctgggcttcggccgcgagcttgaggcccaggccagtgccgcagaagtccacatccatgacaatcgctgacggcaggcgctcggccatggaagcgcgaaaggccgcgacactgtccagggactgggcgctcatgccaaagaattccagctgcttggccaggcgctcggcgcgatcatagtcagcgagcatcacgtagatgggcttgcgcatcggcggcaggaaggtttgctcaagttgatctccctggcgcaggccggtgcgcgacaagcgctgcatcaagcggttgagctcggtaatcaactggctgctcaggcggccgcggttttcgtccacggcttgcagggattcaccgatatgccgggccagctggctgtgttcgggctgttcgaaacgctcggcaaagcgcagcaggcgcaggttggcttcgctgagctcggagaaatcggcgttggaccattcgctacgctgcaggcgctgccagatctcaagaatttgacgtgcctgatgaattacccgctgggcaaaatgctgcttgagccgctcgcggctggggtcttctggctcggtcatatcctgactactgtgagggtgcatgctgaggtcgactgatggctctatgctagcacctcttgtctattgcatgagtgtcatacgtcaattaagtacgtgcgcccggcattcggttatcgacctgctggtcgcacagcgtaaaaagcgtgcatcctttatagtcgaatcgccgttgtgcgccactttcgcggaaaagccccgcaccgatgggcacgatggggtagggttgtggtcggagtgtgtgaacgcacccggacaattgacgtgcatgaactcaagtgattgaaaggatatcgccatgctggactggaaaaaccgtgcaggcagtgccaaaggccccgcccctgagcccaagtcggccaaccgcagctattttcgcaacctgctgatgagccgagccttgctcagcgtgatctgcttgtacctgctggtcaccggtggcctgggttggtactggagccaggagccggcgctgtttccggtccagcaaaacgcccagcttgccgccgagaaggaaggcaagcagatggtggtgggctacaccaccgtcgagaccctcaagaccgtggtcggcactctgctgaacaagcctggcggctacatttccaatgatcgtttcccacctggcctgtggatggacaacatgccgagctgggaatatggcgtgctggtgcaggtccgtgacctgacccgtgccctgcgtaaagattttgcccgctcacagtcgcagtcggctgaagacgccgatctggccaaggctgagccgcgcttcaactttgataacaagagctgggtgctgccatccagtgagtcggaataccaggaaggcatcaactccttgagccgctacgaagcgcgcctgtctgacccgaaccagcgcggcgcgctgttttatgcgcgtgccgataacctgaacaactggttgggcgatgtcgccacccgtttgggctccttatcccaacgcctgtcggccagcgtgggtcgggtcaagctgaacactgcactgaaaaccgaggcgctggcgccgggcgaagtgccgcaggtcgatgaggaagtggtggaaaccccatggatgcagatcgacaacgtgttctacgaagcccgtggccaggcgtgggccttgtcccatctgctgcgcgccatcgaggtcgactttgctgacgtgctggccaagaaaaacgccaccgtcagcgtgcgccagatcattcgtgagctggaggcctcgcaggaaccggtttggagtcctatgattctcaatggcagtggcttcggtgtactggcgaaccattcgctggtgatggccaactacatttcccgggcaaacgctgcagtgatcgatttgcgtcagctcctcaaccagggttgatgatggatgcttcctccagggaagccgcacaccgtgcggcttccgacgctgaactgatctgctgggtcgacgagcaggacaatctgcttggccaccgcgtcaggtctgaccttcgtaagctcggcctgatcggccgttgcacctttatcttcctgttcaattcccaaggcgagctgtgcgtgcatcggcgcaccttgagcaaggcgttgtatcccgggttctgggatacggcggcgggcggcatggtggcggccggtgagtcttacgcgttgtcggcagcccgcgagctggaagaagagctgggtgtcagcggtgtgccattgatcgagcatgaccacttctatttcgaagatggtgacagccggctttggtgcaaatcctactccgcggtgtgggatgggcctctgcggctgcagcccgaagaggtgatggaagcacggtttttaaccatcgaaaccatccagcaggaggccgcacaaacgccctactgcccggacgcccaagaaggtctgcggcgctatctggcctcgcgtcgctaaagttgcataaattggcgccatttggctcttagcaaccgggctttttgtcgttacactgcgcgccttttcacccgaaccattttgcggttcggtagcgctgcccctgcctgagtggggcttcgcggtcggtcaccgtcttgtgcggcgccgatcagtcttcatcctccgaagaggattgccggtggccaaaaaagccgcatccttcgccgccctgggtggcctggtattttccaccgacgcaggtcgacactgcccggactgtcgtcagcccgtggacgcctgcatctgcaaacagaccctgatccccgaaggcgacggtattgcccgtgtgcgccgcgagagcaaaggccgtggcggcaagacggtgactaccatcaccggcgtgcccctggctgaagatgcgctcaaggagctggccaccacgctgaaaaagcgctgtggcaccggtggcgcgttgaaagacggggttatcgagatccagggtgaccacgtcgaactgctgttggccgagttgatcaagctcgggtacaaggccaagaagtccggcggctgaaagcctcttcccaacctgtatctaaactctgtccggggagtggggtctaccctgctcacaggcaaatcgtcattttcattctttagactgcgccagcctccgtgagaggtggcgccttcgccttcatttataggggacttcgatgtccgtacgacgcacacgcaaagacgatggcagccaatggacagttgcggacagccgcagtgtttacgggattcgccattggggggccgggtatttcgcgatcaatgaagccggtcgcgtagaagtccgtccgaacggcccgaacagcacgcctgtcgacctctacgagcaagtcgatgagctgcgcaagagcggcctgtcattgccgctgctggtgcgcttccccgatatcctgcaagaccgcgtgcgccagttgaccggcgccttcgatgccaacatcgagcgcttggaataccagagcaaatacaccgcgttgtacccgatcaaggtgaaccagcaggaagcggtgatcgagaacatcatcgccacccagaacgtctccatcggcctggaagccggctcaaagcctgagctactggcggtgctggccctggcgccgaagggcggcaccatcgtctgcaacggttataaagaccgcgagttcatccgccttgcgctgatgggccagaagctcggccacaatgtgttcatcgtgatcgagaaggaatccgaagttgaactggtgatcgaagaggcggcgagcctcaaggtcaagccccaggtcggcctgcgcgtgcgcttgtcgtccctggcgtcgagcaaatgggcggacaccggtggcgagaaatccaagttcggtctgtcggcggcacagctgctgtcggtggtcgagcgcttccgcgccgccggcctggaccagggcatccgcctgctgcacttccacatgggctcgcagatcgccaacctggccgactaccagcacgggttcaaggaagccatccgttactacggcgaactgcgcaatcttggactgccggtggaccatatcgacgtcggcggcggcctgggtgtggactacgacggtacccactcgcgtaacgccagctcgatcaactacgacatggacgactacgccggcgtggtcgtgggcatgctcaaggaattctgcgatgcgcagagcctgccgcacccgaacatcttctccgaaagcggccgctccctgaccgctcaccacgccatgctggtggtgcaggtgacggacgtcgagaaacacaacgacgaaatcccgctcatcgaaaacaaggaaagcctgccggaaaccgtgcaatggctggtggacctactgggcccgaccgacatcgagatggtcaccgaaacctactggcgcgccacccactacatgagcgacgtggccacccagtacgccgatggcaagctgaccctggcggaaaaagccctggccgaacagtgctacttcgccgtgtgccgccgcctgcacaactcgctgaaagcccgccagcgctcgcaccgccaggtgctggacgaactcaacgacaagctggccgacaagtacatctgcaacttctcggtgttccagagcctgccggatacctgggccatcggccaggtcctgccgatcctgccgctgcatcgcctcgacgaagagccgctgcgccgtgcggtattgcaggacttgacctgcgactccgacggcaagatcaagcaatacgtcgacgagcagagcatcgagaccagcttgccggtgcacgccttgaacgaaggcgaggactacctgctgggcatcttcctggtgggcgcttaccaggaaatcctcggtgacatgcacaacctgttcggtgacaccgactcggtgaacatctaccagcgtgaagacggctcggtgtacagcgccgggatcgagacccacgacaccatcgaagacatgctgcgctatgtgcatttgtcgccggaagagttgatgacccattaccgtgacaagtgtgcgagtgcgaagatctccgcgtctgagcgtacccagttcctggatgcgttgcgcctgggcttgacccgttcttcgtacctgtcctcgtaatatatgtgggagggggcttgctcccgatagcggtggatcagtcaatgaatctgttgactgacactcagctatcgggagcaagccccctcccacatttggatctgcattccttcagtttgctcccagccacagcccttgccgattcaagcgccaggctatcgcccagagtgtcaggctgcgcaccgccatgaacagcaggaaggttacccacaacccgtggttacccaacccctgcaacgcccaggcaaccggcagcaccaacaccaccgtcagcaacatcccattgcgcatctcccgcgcacgcgttgcgccgataaacaggccatcgagcaagtaactccacaccgcaatcaacggcagtatcgccaggtaaggcaggtagatgtcggccgtttcgcgcacgctgggaatgtctgtttgcatggcgataaacagatggccgccgaaggtgaacagcagggcgaagccgatgctggcgatcagtgaccagccgcaggcaaccaccagcgagcggcgcaatgcctggcggtcatgggcgccaatggcgtggccgcacagggcttcgacggcgtgagccaggccatccagcgcatgggccgtcagcaacaggccattgagcaacaaggcgttggcggcgaccgtggcatcccccagccgtgcgccttgcaccgtgatcatgaagaacaccgactgcaaggccaggctgcggatgaagatgtcgcggttgaccgccagcaacggccgccagctttgccagcgtttgagcgcggcccaggcgatatgaccggggtaggcgcgcagggctttttgcgtgagggccaggccaagcagggcgccggtccattcagcgatcaccgaggcgcgggcagagccgaccacgccccagtccaggccgagtacaaaccacaggttaagcgcaatgttcaccaggttggtggtcagcagaatcgccaacggcgcgcgggcgttttgggtgccgaggaaccagccgaccagtgcgtagctggccagggctgccggcaggccgaacaggcgggtgtggaagaattcgcgggtcagttggttcagttcaggggagggctgcatccattccaaagccagatggctcagtggaacacctaccgtacccagcaacgtcgccaaccccagcgccagcagcaagccttgcaacaggatttgccgcagcgccgccccatcattgcgcccggcggcctgggcggcgaacccggtggaacccatgcgcagaaaacccatggcccacgccaggaaggtatacaggctggcgccgacggccacggcgcccagttgatgggcgtggggcaggtggccgatgaccatgctgtcgaccagggccaccagcggcacggagatattcgacaggatcatcggcgcggccagagcccagacgcggcgatgggtggggcggtggcgccagtcggcgagcagggcggtcatgaaggctccttggtggagcgggcattgtacccgtccaccagattcaatgtgggagggggctgtggggtttggtttagtctggaaggcactcagaaccaaccctccctccgtcggtcaatgtgatcagcgccacagcggcttggcctgcgctgatatatagttcacccctcggttccctctgactatgagtgccccatgcttaacaaaggactgttcctcgcttgcgcgctggccctgatgagcgcctgtgattcttccgataaaccggctgcaccgacggctccccccgcgccaagcgtagcgcctgcacctgccaaggcggcggtggacgtagcggcgttgaagcagcgctatgccgggcgtgagttgagtgtggtggacgtgtccgaagtgcaactggatggggccagcactttatcggtgagcttttccattcccctggacccggagcagaaattcgccgataaattgcacttggtggacagcaagtccggcaaggtcgatggcgcctgggagctctcggataacctcatggagctgcgcctgcgccacctggaaccgcagcgcaagctggtgctgacggtggacgccgggttgaaggcggtcaacgacaaccagctcgccgccgaatataccgcccgcctggaaacccgcgacctgcaagccaccgtcggcttcgccagccgaggtacgctgctgccgacgcgcctggccgagggcctgccggtgatcgcgctgaatgtcgacaagatcgacgtcgaattcttccgtatcaagcccgaatccctgccgtcgttcctggcgcagtgggggcgcaataccagcctgcaaagctatgagtcccgggaactgctgccgatggccgacctggtgtacggcgggcgcttcgacttgaacccggcgcgcaatacccgcgaaaccttattgctgccgattgccggcctcaagcagttgcagcagccgggcgtgtacctggcggtgatgcgtgcttcgggcacttacaactattcgcaaccggccacgttgtttaccttgagcgatattggcctgtcggtgcaccgctacgccaaccgcctggatgtgtttacccaggcgttggaaggcggcaaggcgctgaacgacgttgagctggaaatcctcgatgccgaaggccgcgtgcttggccagggcaagaccgaagacggtggccacgccgagctggcgctgccgaaaaaagcccaggtgctgctggcaaaactgggtgaacagaccagcctgttgcgcctggatagcgccgcgctggacctcgccgagttcgatatcggtgggcaaccgtcccacccgttgcaattctttgtgttcggcccgcgtgacctgtatcgccccggcgaaaccgtgctgctcaatgcgttgttgcgcgacaaggatggcaacgcggtcaagccgcagccggtgagtgtcgaagtccgccgtccagatgaacaggtgagccgcaaattcgtatgggaggccgatgcctccggcttgtatcaatacccgctgcaactggccggcgaagcgccgaccgggcgctggcagttggtgttcgacctgggcgatggcaaaccgcagctctatgagttcctcgtcgaagacttcctgcccgaacgcctggcactggaactcaaaggcagtgacacggcactgagcccggcggataacgcggttatccaggtcaacggccgctatctgtatggcgcgccggcatccggcaatcgggtcagtggccaggtctatgtgcgcccgctgcgtgaagcggtcaaatccctgcctggctatcagttcggctccgtcaccgaagaagaactgagccaggatttcgaattggacgaaagcgtactcgacgccaacggcgaggaggcgctgaccctggaaagcaaatgggccgaggccaagtcgccgctgcaattgattgttcaggccagcctgcaagagtcgggcgggcggccgatcactcggcgcctggtgcagccgatctggccggccgagcaattgccgggcctgcgcgggctgtttgatggcaaggaaaccaatggcgatggcccggtggaattcgaagtgctggtggccaaccaggacgggcagaaactcgccgcccaaggcctcaaggtgcgcctggtgcgcgagcgccgtgactactactggaactactccgacaacgacggctggagctaccactacaacgagaaattcctcaacctcgacgagcagaccctggacatcaaggccggtgacaccgccaaggtcagcttccaggtggagtggggcccttaccgggttgaagttgaagacccgcagaccggactggtcagcagcgtgcgtttctgggccggctaccaggcccaggacaacaccgaaggcggcgccgtgcgccccgaccaggtcaagctggcactggataaacccgcctatggcgacggcgataccgccaacgtcactgtcaccccgccggctgccggtaagggctacctgctggtggaatctgccgaaggcccgctgtggtggcaggaaatcgacgtgccggccgaaggcaagagctttgcggtcaagctcgacccgaaatggtcgcgccatgatctgtatgtgagcgccctggtgatccgtcccggcgagcgcaaagccaatatcacccccaagcgcgccgtgggcctgttgcacctgccgctggaccgcacacagcgcaagctcggcctgaccctcactgcgccggaaaaaatgcgccccaaacaaccgctgacggtgaagatcgccgccaggaatgccgatggcagcgtaccgaaacaggtgcatgtgctgctggcggcggtggacgtgggcattgtcaatatcaccgaataccccacgcccgatccctactccagcctgttcggccgcaaagcctatggtgtcgatcagttcgatatctacggccaactgatcgaagccggccaggggcgcctggccagcctggcgtttggtggtgacgcggcattggccaagggcggcaagcgcccggacaccagcgtgaccatcgtcgccctgcaaagcgcgccggtgacactgaacgaaaaaggcgagggcgaagtcagcgtcaacatccccgacttcaacggtgaactgcgcctgatggcccaggcctggagcgatgatcgctacggaatggccgaaggcaagacggtgatcgccgcaccgctgatcgccgaattgtcggcgccgcgcttcctcgcgggaggcgaccagaccactttggccctggacctctccaacctgtcgggcaaggcgcagaagctcgatgtgcaattgaccgccgaagggcagttggagctggtcaacggcggcgcccaagcggttgaactcaagcaaggccagcgcaccaccctgcgcatcccggtgaaagcctggggcggtctgggccagggcaaaatcaaggtcagcgtgaacggcctggacctgccgggggaaaacctgccgccattcagtcgcgaatggaccttgggcgtgcgcccagcgtatccggcgctgctcaagcactaccgcgcagtgctcaaggatcagccatggagcctgcccgccggtacgctggaccagttcgatgcctccgggcgcgaagcgctgttgagcctgtcgagccgtccaccgttgaacctgggggcacagatcagcgcactcaaggcctacccttatggttgcctggagcaaaccgccagcggcctgtacccatcgttgtatgctgatgacgcactgctcaagcgcctgagcatcaagggcgagccggatgccgagcgcaagcgcaagatcgagctgggcatcgaacgcctgctgggcatgcagcgctacaacggcagctttggtttgtggggcgccgacggcgaggaagaatattggctgaccgcgtatgtcaccgacttcctgctgcgtgcccgtgaccagggttttgccgtaccgcctgaagccttgaagaaggccagcgagcgcctgttgcgttatgtgcaggagcgcaacctgatcgaagtcgactacagcgacaacgccgagcacacgcggtttgccgtgcaggcttacgccggcatggtgctggcgcgcagtcagcaggcgccgttgggagcgttgcgcagcctgttcgagcgccgcagcgatgcgcgctccgggttgccgctggtgcagttggccatcgccctgcagaaaatgggcgatcaaccgcgtgcggatcaggcgttgttggccggtttggcggcacagcgcggtagcaaagaatggctggctgactatggcagcccattgcgtgaccaggcgatgatcctggcattgctggaagaaaatgatttggccaagggccaacgtgaagagcgtttgttcaccctgtcggaccagttggccgccagcccgtacctatcgactcaggagcgtaactccctgttcctagccgggcgcctcgggtttgccaagccggaagccaactggcaagtgtcgctcaccggcagcggcggggcgcatgagttgaataaccagcaatcgaccctggcgttggacggcaagctgctgtccagcgacctggccttgagcaatcagggcgaagcgccggtgtatcagcaattgacggtctcgggttatccacaagtgccgccggctgccggtggcgaaaacctgagtatccgccgcgaatacctgggcatggacggccagccgctcaacctgcgtagcctcgccagcggcgacctggtgctggtgcacctggccgtcagcgccaagcagcgtgtgccggatgccctggtggtagacctgctccccgccggcctggaactggaaaaccagaacctggcccaaagcgcggccagcctggaaaacgccagtagccaggtcaagcagtggcgcgagtcgatgcagaacgcatcgctcaagcatcaggagttcagggatgatcgttatgtggcggccatgagtctggacggttatggcaccacgcacttgctgtacttggcgcgggcggtgacgccgggaatctatcgcgtgccgccgccgcaggtggagtcgatgtatcggccgaactggcaggcggtgggcgagacgccggtggatatggtgatcaagggccgctgattgctcaagttgaaatggggactactgtgggagggggcttgctcccgatggcggtgggtcagtcaaaatgtcattggctgacactcagctatcgggagcaagccccctcccacaagggattggggctgtcagttaaatcagtgcacaacccaactgagcaaccacaggcccagcagcagccagatgatgcccatgatgatcgaggcgcgcataaaggcgcgtaccgccgagtacagcaagagcaggccaacgatcagggtgatgatgctgatgatcgaggtgtccatgcccaaggtgcgcgacaggccatcgataaagttgccgccggcgtgggtcaaggccccgaacaacccactgagtccgtcgacgatgaaccggatgacggagccgagcgcctggcccaaccattcgaaaaagctttctacctgcatgtgcgtgtcctgaataagaaggtgggcgtgactgtgcctttggtcgttattgccacaggctagttccctacaagcatagaggtttgcccgcttgaatttgcgttttgttgcccgctggaccctggcgagcctgctgttggtgattgccttgctgtggctggctgatcggatctggccattgcccttgccccaggacgacctggcccgggtggtgttggccgaggatggcacaccactgtggcgttttgccgatgccaatggggtgtggcgctatccggtgcataccagcgaagtgtcgccgtattatctcgatgcattgctcacttacgaagaccgctggttctaccagcatcccggggtcaacccgttggcgctggtgcgggcgacgtggcaaaaccttacaggtgcgcgggtggtctccggcggcagcaccttatcgatgcaagtggcgcgtttgctcgacccgcattcgcgcaccctgcacggcaagttgcgtcagctgtggcgcactgcgcagttggagtggcacctctccaaggacgaaatcctcaacctgtacctgaacagagcgccgttcggcggtacgttgcagggtgtggcggcggcgagttgggcgtacctgggcaagtcgcctgcacaactgactcacgccgaagccgccttgctcgcggtattgccccaggcgcccagccgtttgcgcccggatcgtcatccgcagcgcgcccaggaggctcgcgacaaggtgctgcgccgcctcgccgagttcaaggtatggccgcaatcggcggtcgatgaagccctggaagaaccgctgctgctcgctccgcgcctggagccgagcctggcgccgttattggcgcgccgcctcaatcgcccggacagcccgccgctgatccgcaccaccctggatgccaccttgcaacggcgtctcgaagacctgctgctgggctggcgcgcacgtctgccggaacacacctcagcggcgatcctggtggtggaggaagaaagcatggcggtgcgtgcctacctgggctcggtggatatcaatgacaccaagcgctttggccatgtggacatgatcagcgcgctgcgttcgcccggctccacgttgaaacccttcctgtatggcatggccctggacgatggcctgattcactccgaatcgctgttgcaggacgtgcctaggcgttatggcgattaccggccgggcaatttttccatgggctttaccggggcggtgccggcgagcacggccctgtccagctcgttgaacctgccggcggtgcaattgctggaagcgtacgggcccaagcgctttgccgcacagatgcgcatcggcggcatgccgctggcattgccggcgctggccgagccgaacctggcgctgatcctcggcggcgcgggcagtcgcctggaagacctggtgagcggctatagcgccttggcccgcgacggcaagagcgccaccctgcgactgcagccggacgataccctcagggaacggccactgctgtcacccggggcggcctggattgtgcggcgcatcctcagcggccaggcacggcccgatcgcgacccgcgtgccgagctggtgcagcgcccggtgctggcgtggaaaaccggtaccagctatggctttcgcgatgcctgggcaattggcgtagggccacgttatttgatcggtgtatggatcggccggccggatggcacgcccgtccccggccagttcggcctggcgtcggcggcgccgttgatgttgcaggtacatgacgtactgaccaaccgcgacagtcagcgcggcatcagcgcgccggtcaaaccggtgccggcgaatatcggcgtggcggcaatctgttggccgctgggccagcccatgagccgcagcgaccccaactgtcggcgccagcggtttgcctggaccctggacaacaccacgccgccgaccttgcaggcactggaccaacctttgagtgtgggcttgatggaaagcatctgggtcaacgtcaagggtttgagggtcgacgcgcattgccctggcgcacaggccaagcacattgccctgtggccggcgccgctggaaccctggttgccaaggatcgagcgccgtgaagcacgcatcccggcccctgacccggactgcccgccaccggcgctggctgcgtcgtcgccgttgtccatcgtcggcgtacgcgaaggcgaccaactgcgcttgcctgttgccagccaacaaaccctgcgtctgaaaatctccgccttgggtggcagtggtcggcgttggtggttccttaacggcgcgccgttgggtgatagcgccaatcaggacagtatcaatgccagtttcgagcggttgggccgctatcagctaagcgttctggatgaggctgggcagaccgccaggcttgagttcagtgttgttgattagggcctcatcgggggcaagccccctcccacactttgatttgtgaatacttccaaaatgtgggagggggcttgcccccgatggcggccttgagcacatgaccgctattcacttgccttcactccccatccccctgaagctatacccattcaggagtcccctaatgaacctcgaacacctcaccgaacgcctgcaccgcatccgcgataccaacgattggaagcagttccacagcccgaaaaacctggccatggccgccagtgtggaaatggccgaactggtggaaatcttccagtggcttaccgaagaccagtcccgccagcttcccgccgataaacttgcccatgccggccaggaagtcggcgatatcgtgttgtacctgctgttgttgtgcagtgagctgggtctggacatgaacgaagtcgtgagtgccaagctggccgacagcgagcggcggtttgcccatgagtgatcgtcatttcgaccagttggccacgcgtttcgccgaaaaaatctacggcggggccaagggcgcgattcgcctggcggtgctccaggccgacctggccgaggccttgccgcagcgcccgttgcgcgtgctggatatcggcgcgggcctggggcatatgtcgctgtggctggccgagcgcggccatcaggtaaccttggccgagcccgccgcgccgatgcttgaaggcgcgcgccagcgctttgccgacgccggccagaccgcgacgtttatccatgcgccgtggcaagacttgctcggcctactcaccgagccttacgatctggtgctgtgtcatgcagtgctggaatggctggccgaaccccatgccattttgccggtgctgcaccaattgacgctgcccggcggctgcttgtccctggcgttctacaaccgtgatgcgttgatctaccgcaacctgctcaaaggccacttccgcaaaatgcgcaagaacgacatggccggtgaaaagcagagccttacgccgcaacagcccctcgacccacgggagttggcggcgcaacttgaagggatgtggcaggtcgaaagccaaagtggcgtgcgggtgtttcacgactatatgccggtagaattccaggcccgcgccgatttgcaggacttgttggagatggagctcgctcaccgtcgtcacccaagctttgccggacttgggcgttatttgcactgggtctgccgtccggtttaagcggaccagcctgcggaggtcgaaatgcgtcgtctctgtttgatcctgttatccctcggcctgggcgcgtgttccagccccaacccctacgtcgcctcgtcggcaccgatgccgccggccccggcccaggcggccaccacttttgatgccagcgcttacccggcgccagtgcgcgattatggcgcctaccgcagttggggctggctcaacggccagttgcctgcgggcacggcctgggccgattcggcgcagattgccgaggcggtcagcggcgccctcgaccagcgtggcctgcggcccttgcatgacaagcgtgcccccgacctgttggtgagcgccgacgtacgcctggagaaacgcctgcgccaggtgcaggatgactatggctacggttacggcggttataaccgctacggcaacggctatggcatgtacaacagcgtgcccgtagtgcgcacctatgaagtgacggtggcagtggcgcgtatcagcctgttcgacgcccgcacccgccagccggtgtggagcaccagcgcggaaactaccagccagggcagcttgagcgagcgcgccgatagcttgcgcaaggcgatgcagaaagcaatggctgcctatccgcccagttagcagctattctcatttcaggctcacgttgtttttggagaagtgccatgtttcgtcgtatcgctgcacttgctgtcgttgtgttgctgggcggttgccagagcaaccaggtcaatcacgatttcgacgccagccgagacttcggcgcctaccgcaattgggcctggaaagacccggcgttgcagtaccgcccggatgatccgcgaatcaagagcgaccttaccgagcaacgcatccgccaagcggtgggcgaacagcttgaccagcgcggcctgcgccccgcagcggccggcaccaaggcggacctgaatgttcaggcctacctgatcgtcgaagaccgccagcaacaagtcaccaccaactatggaggtgcttggggcggcccctggaatggctactggggcgcgccgatgtataacgaaacgcgcaacattacctacaaagtggcaaccatccagatcgacttgctcgacggcaaggacggcaaactggtatggcgcggcagcgacgagcaaataatggccagcacgcctaatccagaggatcgcagcaaggctatccgcagtacggtgaccaaaatcctttccaactacccaccgcgctgattaccccctgtaggagcgagcttgctcgcgaaaaacgtcaacgataacgcgtgcttcctgaatcaacgcggcgcctgcgagtttttcgcgagcaagctcgctcctacagtattagggcatctccgtcagtcgccaatgtggcgagttgccagcaacctgccaaagccttgtctacactccagtgcaacgccggagagttagcgcaggagtgcttcgatgtctccccgattcggttccaggcagcgtggagcaattggcttgatgacggcaggcaccttggcgttggccctggtgtttacgttgctggcggtcgacagcgggcgtttgtacctggaaaaacgcaagctgcagtccgtcgccgatacgtcggcgctggaagcggctggcctgggtggccaatgcggcaccagcaccacggccaacgcctatgccacgcaaaatgcctctcgtaacggtttcgtggtcggcaatggccgcaccctggtcgtgacgtgcggcaccctggcgaccaatgccgccaacactcgcgtgtttaccgccgatgccaccaagagcgacgcgattcgcgtggtggcctcccacaccgtgatgaccagcatcgctaacggcttgtggaacctgttcagtggcgcgccgatcaccccgcaactcaacctgagcgccactgccgtagcggctacaccgccgccggtggcgcaactgacgatccgcagcagcctggccagcgtcgactcaagtaaatcccccttgcttaatctggtgatgggtaacctgctcggtggaagcctgtcgctcacggcggcgagttggaacggtttgttgcagaccaacgtcaacctgctcggttacctcgaccaattagcgatcgacctgaacgtgaaggccggcgattacgacgcgctactcagcacggccgtctccgccacccagttgatcgacgccgcggtcaaggtcttgcagaaaaatggcgcggcggtcaccgcggttatcaatgacgtgatttcgattgaagccattgcgccgaacaccaagctgttgacggtgggcgacctgattgatatcgccaccggcaccccgacggcggcgctgaattccaatgtgcagctgtttcaattgctcgaagccgtggcgcagttatccagcagcaagaacgccgtgagtgcggcggcgcagctcgctattccgctggtgggcaatgtgtcgatccagaccaaagtcatcgagccgccgcagttgtcggctatcggcaatcctgcgctggcgaagaagggcttgttgaagaacccgccgaccgatcagatctttgtgcgcaccgcacaagtgcgtacgctggtgtctattcaactgcccgtattgaatggcattaatgggctgacatctgcggtttccgccatcaccactccggtgacaggtgtcgtaaataacttgttgcatttgaatttggtgggcctgctggatccggtgttgtgcctgattttgaagccctgtgatcacaccgatgttcagttgatgagcggcctggatatcaatatcgaggtggcgagcgcgagaagccatgtcacggatttcaattgtgcgagcaatgcgacgaaatcgctgactgttcaggttgagactgcgcttgccgatgtttccgtaggaaaagtggatgcggcgcaggccttttcctccgcagtaaaatccgaagtgaatccagtagccctggtggatattggcgtacagacctgcaaggggatatttggctgtggtccacgcaaggcaggcgtaggcggtagcctatccctatccgtcgtccatgcgaccgtgggagggacgagtcaaagtctgctgttttctccggtcaacgacatgaatctggcgcccacctataagtctgttcctccctcgacagaggtggtcaaagggctggtcaacacattgggggcgatccaggtgaattatgttgccccaaccggtagtgcccctggcggcatcctaccggcggtgtcgggtttactcgcgaccattaccaatacgctggtcaccgcgatcaagaacgttttgtcgccagtactcgacccgattgtggatggcttgttgagtgcactgggcatcaacctcggaaacgccgaagtcggtgccaacctcacctgccacatgggtcgggcttacctggtgatttgatccggtacgatgggcaactccacgcaaaatttcgcgcctgcctcgccattgctgacgctcaggcgcccgcccatgttttccacgatcccatagctcaccgacagccccagcccggtgcccacaccgattggcttggtggtgaagaacggctcgaaaatccgctccagcaagcgcgggtcaatcccgccggcgttgtcttcgacccagatgcgtacgtggcggccgtcatgctcgctgcgcagcgtaatccaggggcgcagtccgggagtcttttcgcgctggctgagcaacgcgtcgcgggcgttgaccatcaggttgatcagcacctgttccaattgatcgacatagcctttgacctgcactgagaagtccgcagggctgatgcgtacttccacacccttgccgcgcaggccttcgctgagcagggccaaggtgccctccagcgcctgcgccgggtcaaagggttgctgttcgatttcagagcgacggccgaagacgcgcatatggtcgaccactcgtgccgcgcgttgtacctgggcgtcgatgcgctggagtttttccgtgaggtaatccacttgtacatcgccattgcccaggcgcttgagcacgttgacgacggccatgtgcatcacgttcagcggctggttgatctcatgggccaggccggtggccatttcgccgagggtggccatttttgcgctttgggtcagttgttgctgggagcgacgcacttcggtgttgtcgcggcccacggcctgcacttccaacaaggtgccgtgttgatcaaacacgccacggtccgaccacacccaccaggcatgctcacgcccaggcagttgcaggctgatttcagccgtgctcaccgggaactccggggtcagccgcgcaatgcgctgcacaaaggcggcgcgctgttcatccgatagccattggcccaggtcgatgccgggcagttgggcgggcaggcattccaggtagttggccagcggcgtgttgccgaaggtcaggatcaggtcggggcgatagcggcagatcattgctggcgaatcttccaccaggatgcgatagcgctcctcactctgacgcacctgttcagcggccagggtcgcctcggtcacgtccagccacaagcctacggcctccaccggcagcccgaggtcgtcgcgcaacagtttggcttcgtcgagcagccagtggtagtggccctgtttgtcacgcagtcggtagcggctgcgcacgttgccttcgcgtagcaattggcgagtgcgttcaaagtagagttcgcggtcgtcggggtggatcagcgccgccagggtgtcgaggttgcagtcggccagggtccagcccagcagtggtagcaggctgtcactgaaaaacgccggatgcagcgcgccgttgacgtagcgctgcacatagatcaccgccggtgaactggcgatcaggttgtccagccgcgcatgggcggcggcggcttgcagttgctggttcttgatgtcgctgatatcgagcatgaaaccgatccagcgtcgctcattgccaactcccagcacttgtccctgtatgcggtaccagaggggcgcctgctcggcctccgtccgcagcaggcgcacgctggtcagcaagggtttgcccaaagcttgcaagtcttgcaggcggctgttgagggcctggcggtcgaccgggtggatcagttcaagccaagtgccaagggcctggcgagtggggccctgctccaggctcaggttgcgcagcaattgtggcgccagctggatttcctgggtggcgggcaacaactcccaccagccggtgccgagcaggccttgcagggcttctacccgttccagttgctggtgatgacgttgttcacgcaggcgactgagcaacggtgcggcgagggctgcgcagagattaagccagtcgcgctcacgggtatgttgggcctggccactgtagaagccacacagcaaccacgccgcgacaccttggctgtcgcggtaaggcaccaggaagccatcggcattgccaaacacgctgtgcaggcgcgggttgtcgctgcggccctgggcaatgtccaggctcagcggcgtgttgccgttgatgctgtccaggctggtgcccaagtgttgcccggtttgccacagggccggcgcatcatgggcggcatattgactgtagatgcgccagccttggtcctcctcgtcgagcagcgccatagccacgcacggcatgcgccagcgctgagcgacggtgcgcaggtgctcgttgaacacctggggtaggcggttgaggctgcacacgcgcaattgttcgttcattaggccggtgatctgatggttctgttcgcgctgctgttccaatgctcggtcggccagcaggtcagtaatatccagcaagtgcagggcccagccgtcgccctcgggctccatccagccgcgggtatgcaggacctggccgccggcaccctgaaagtccaggtccaggccatggcgttgccattgctgcggtgtgccctcgacactcaatgcgctgttggcgcacagcaaggcatgcaacggtggggtgtttgtgtgggtgaaatggtgggtgagcaagggttgcaaggtgccggcgatgctcagcacatggcccaggttgtccagttgcaggtgcaggcccagcgcggtcatggccggagcgctgtggcgcccgcgcaggcgcgcgaacagtttatcccctgccgtcaaaactgcaggctcgaggtggcggtgaggttggcgggcaggttcggtacgctgccaactccgggcagtaccaaggccggcagcaccgctttgatattggccgaggggtaggtgatttttaccgtcagcaaattattggtgtaggtggcagtgatgtagccgggcaagaatttcaacgagccggggatccaattcaactgggcctgcgccgcatccttggcgcgctgtaccaccagtgccgaatagcctgcggtacttgggtccaaggacacactgcggcgcactccctccgctgccgcctgatgaaaggactgcatcaacagcagcggcaagctgtagctgagcatgccgtagaacaccgcaaagaagatcacgaagaccaaggcaaactcgatggccgccgcacctttttgctttctagggaagcctgatttcatcactgcgtctaccctgaggcgagtacctgatatcagcatagaatcattcggcaaaaagggatgttttttacgtgatccactatgtagtgattctgctgtggttgggcctgtgtgcagtgcaggatattcgccagcgccagattgccaatacgctgaccttgggtgctggtttgctggcgttgatctacctgctgtgggcagggtcgacctgggtcggtgcgccccgcagcgaaggcggcctggccttggttctggcgctgatactgaccctgcccgggtatgcgttgggccgcttcggcgcgggggatgtgaagctgctcgccgccctgggcctggcgtccaatatcgacattctgttggggtcgctgatcggcgccgcggtcgccatgctggcctggacatttgtgcatcaagggcttagctcgagccagtttgagcgggcagaaaaagtgtcaaaaaaacagccttttgcgcctttcgttttgacaggtttcgtcgggtgttggctttggatccattaagcgcgcgcgttgaataatgctatgtacatagtcagaaagtacgtctacgtttaatgagtagttgtataggatttttcgtcaaaaaggatgggtcctctttggcttgccaggcatggagtagcgcgtgaacaagctcacatctgcagtaaaagtgctcgtggtcgacgatcaacctttgatcgtggaggagctctgtgaatttctcgaaagcagcgggtaccgttgtgtcccgtgtgagtccagccaacaggcgatccagcgcttcggcgatgaccccttgataggcctggtgctgtgtgacctgcatatgccggacatggacggcatcgagctggtgcaggccctgcagcaggttgccggcaaacatcgtgcgttcgaagcgatcatgcttaccgggcgtgccgacaaacaggatgtgatcaaggccctgcgcgcggggatcgccgattactaccagaagccgatcaatctcgatgaggtgctcgaaggcttgaagcgccaggaagcggccttggaggaacgacaaaaagacctgcaactgggcacgcttaaccagaagttgcagtacctgtccgaatccatcaacgacttgtatatggacctggacagggtgcgtcgcaagccggtgcccaaagagggtgacggcgaaccgttggccgatgatgccgggccgctcgaagtcccggcgatcttcagtcaattgtcaccgcgtcagttggatgtggcgcgcctggtgggcaagggccagaccaactaccagattgcctgtgacctggggatcaccgagaacacggtcaagttgtatgtgtcccagatattgcgccttacccatatgcacaaccgtacccagctggcgctggcgttgtcacccagcaactcggcgatgcaccagcgggtgacggcgcactgaaggcccggcgcctgcgctaataatgtaggagcgagcttgctcgcgaaaaacgtcaacgataacgcgtgaatcctgcataaacgcggtgtcgtggggttcttcgcgagcaagctcgctcctacagtgggttataggcttggctattggctcccaccctgtgcagacccgcccaccttctgatcaaagaactccgggatcgggtgcttgttgctgtccagccagcgcttgagtgcctgctcgcgttctgccggcgtggtcttctgcgggttggccgaggctgcgcggccgcttagttgcagcgccatccagttttcggtttccgcttgccgtggagaagacggcccagcttcgatggccgatgccatgagcggcagtgtcaacacggcgaggccggcaaggtaatggattttcatcatcgactccctatttcacaggtaccggcagcgtgtcgctgaccgtcgcgacctggtctttggctgaacgcaccggtaccgtgcgtgaacccttgagttgttgtgcccgcgcctgggcttcggtgacctgctcggggctcagtccgagttggccgaccacttttgcggcctgttcccagttgtcctgataaatcagcaaggtcaccaggttcaacgccgccaattgatcgctctgcttgagctcgatggcagtcatgaattcgaaacgggcgtcttccaggcgcagttgatcgaggtacaccacgcccaggtcattgcggattttctcgtcggtgggcgccagccttgcagcacgttgcaggtgggccatggcctggccgttgtcgcccctggccgacgccaattgccccaggccgtgctcgccatcggcagccaggcaggtgcccaacaggctgcggtacagcggctcggcctcgctgcgccccagcaagcgataggcacgggcctggcgctggcgcacctggggcagggcattgggcaggttctgcaggttggccaggctggcgtgcagcttgccttcgttggccatgtcatcggccaggttcaatgaaagctcctggtccgagctgggcttggggcaactgccgggctgcagcaacccggcccatggaacctggccattgctggcacagccgcccagcatcagcaggctcaaggcgacaatcagtggcttcatggcaggctcctcagaagttattcaaggcccgggcgatggcgataaaggccggccccccaagcacagtcagcagggcgggaaacaggaacaccatcatcactacggacatcttcgccgacatcttcgagatgtattcctgcaggcgggtcaggcggcggtcatcgagcaattgcttgagcgccagcagtgacttcatggcaccgccaccctgctggatcaattgctggagaatgatgcaggtgtcggtgaactcatccacagccagcaggcgcgcggtcttgcccagttcctccgacaactccaggcccgagtcgacccgtaccagaatcaggcgcagttcatgggtcaggtccgggagcaggcgctgggcgtcgatactcaacacccgcagcgactgttcaaccgccatgccggattcgaacaggatgcgcagcaacggaatgaatgtggagatctctcgtgcgatgcgttcctggcggtatttcgcgcagaggaccagcacgcgcttgggcaacaggtaaccgacccccagggcaatggccggcgcgatccacggcgagcccacatggggaaacagcagttgctggccgagcacggtcaggcccaacagcacaatgggcacgccgacctggcaggcggcgaacatggaacgctggttgggcttacgccagccgacgcggttgagcaaggtctgtgtttcgttgtccaggctgaccgagcgctgcgccaccgcgctggcgcccagttggcgcatcaggctgccaagtttgtcttcacgggccagttggccttgcaggcgttggttgaccatgcgctggcggcggcgttgttccagcaggctgccggcgatcaagacgacggcggcgagtaacagcaggaggctgatcaggatggccatctcaaatactccgcaacatgcgccacatgacgaaggtgcccgtgatgtcgagcgctaccgcaccgagcagcaggtagcgcccggttccgtcattccacatgctcatcaggtagcccgggttgaccatcaggaagtagccgaccatggcgatgggcaaccccgccagcacatacgcggtcatgcgcgtttcaccggtcatggccttgagctggcgcgcaccctgctcgcgctcgcggatcatcttgatcagattttccagcaactcgctggcgttgccgccgtagcggtggttgaccttcaggcccagggcaaacaggcgaaactcatcgcgctcgtagaactcggcaaaatcgctggcggactccggcaggctcacgcccatttgcacattgcgctggatgcggctcatcgcttgcttgaggggcgcctcggtgctttcgattgcacccagcacggcatcggccagagtgcgtccggacttgagactacgcacgctgtggtcgagcaactgcggtagttgttcgatcatgcgttgcacacgccgctggtaacgccaggcgatgtacaggcgcaacagcaacggtggtaccaagagcatggcgagtaggcccagccagtcggccaacaggtagcccagcaccatggccaccgcccagccgctcaaccacagcccaaggcgatcggtgggcttgcccaggccggcgcgctggaacatccgctccatggcgacccagctgctgttcgattcctgggggatgggctggccctcggcaaggcgctccagcacgcggtcggtgccggcctggcgcagcccgcgctggaacagccagatggacaggctgaccagcagaacgcagataagcagcaggataagtccggtcatgacgcctccctacaacggcaatggcgtttcgcgccgcagcttgtcgccggccgggtgcaacgcttcgcgcaggaagccaaagccggcacggcggtcgaagcggaacagggtattggtgacatacacgtcgtcgcgcacgccgaccacttccaccacctcgctgacgcagcggcgcccatcgggcaggcgcgtcagctgaatcaccacatccagtgcggcacagatcatctggcgcagggttttttccgccaccacgcgcccggtcaggcccaccagggtttccaggcgcagcagcgcgtcctgggcgttgttggcgtgcacggtgctcatggaaccgtcatggccggtgttcatggcggtcatcacgtcgagtacttcgacgccgcgaatctcgccgaggatgatgcggtccgggcgcatccgcagggcgttgcggatcaggtcgctggccttgacctcgccatgtccttcggcattgggtgggcgggtttccaggcgcacgacgtgggggtggcccagttgcaattcggccacatcttcgatggtgaccaggcgctcgtgggggttgatcaattggctgagaatattcagcagtgtggtcttgccggtcccggtaccaccgctgattaggatattgcagcgtttgcccaccgcttcctggaaaaactcgaagatgctctggtcgatggtctgcatcgccaccaggtcgctgctcttgagcatgtccttgcgaaatttacggatcgacaggcaggggccgtccaaggcgatcggcgggatgatcgcattgacccggctgccgtcgggcaggcgcgcatcgaccatcggcgacgactcatccaggcgccgcccgaggggcgcgaggatacgctgcatcacccgctccacatggtgcgcatcgataaagcgcaggtcgctctggtgcagcacaccatcacgttcgataaacacccggtgcgggccgttgaccaggatctcggtgaccgacacatcgcgcagcagcacttccagcgggccgaagccggtcagctcatcgacgatttcttcggccaggcgctccatctcgtaacgcgagatcgccaggtgcatacgcgtgatgtactcggccaccttgtcgatgacaaattgcgccagggattggcgcgagccttccagcaggttctgtccggtctcttcgatggcatcgataatgtaacgatgcagcaccattttcaggctgtcgtggtcgttgcgcccggcggctccacgcgtgggggcgccgaagagcttttcaccgttcatcgacctgaccccagtagacgttcgaaccagcgcgtggacggtttttccatgccctcggaacgttttgccaggcgctcgcccaactgacgcaaagtgtgggtaagggcttcgcgcggggccagggtgaacagactttgcccctggttcttggcattcaggcgcacttcagggctaagcggcagcaccgcgatgcactccaggccgaagcttttttccagggtttcggtgtcgggcgcgcaacccttgatatagcggtcgaccagcagtcgggcgtggtcgagcttcatgcctttttcgcgccacaggttcagcaccgcgaggttgcgccggcagtcgagcacgccttggtcggtgcaccacagcagtttgtcgcagtggctgacaaaggtgcgcaacggctcgctgtcagcctgcccggtgaggttgaccacgatgtgctggaagtgctggcgcaaggcgctgagcaacatgtacagctcggcggcgctggtcatttccaggggctcgtcgctggcggcatacgcaagaatgcgcaggccctcgtcggtgctggtaaaggcgctgttgatcagtgtggtgtcaaggcggcgcaggtggcgcaaggcgtcaccgaaattgaaggtactctccaggcccagcagcgccaggctgtcgccccgcggcaggccgaggtcgagcagcagtgtctgttgaccgctcttttgcaccaccatcgccaagtggctggcgatcagggcgccgtcggtattgccttgggtgccgtatagcaccgtcaggccaccaaggtgggcgttcggcgcggtaggcggcaggcgcttgctcatgcgtcgcaccaacccggccacttcgctggagcgtgaaccataggcgacaaaatcccgggcgccggcgcgcatcgcgttgagtaccaactggttgtccatgccgtcaccgagggcgactacggccagcatcggcttggcttccagggcgccttcgatcagggcgctctgggccaccaggtgttcgcggtccaggcccacgaacaccaggttggcgaaggtcacgtccaccagtgccagcaattcatccaggctgccaccgccgacgctgatcacttggccaagcggggccagcgcgccctgcagccactccaggtcagtgttgttgcgggtgattgccagaaaggtctggcccaggctatcgctcattgggaaagtccactgcgacggtcgaagttgccgttttcaagaaagaacaggcggaaccagttcgggtcgtagttgcgcagtttttccccgggcaacgacggcaactgtgcgttggccgccaatggccggaccaggtgcggggtgacaatcatcagcagctctttttcctcgctgcgaatattggagtcgcggaaaaacgcgccaattatcgggatatcgcccaggccggggagcttggcgatggtggagcggttggtgctgctgatcaggccactgatgacaaagctttcgccatcggccagcgatacgctggtgtcggtgcgccgtacggtcagggcgggcaccaggatgccctcgatctggatcgcgttgttgtaatccagctcgctgacttccggtgcgactttcagggcgatgcggttgtgatcgatcaccgtgggcgtcagggtcaggcggatgccgaactccttgtactcgatggaaatggtatcgctgccggcactgggcaccgggatcggcacttcgcccccggccaggaaggtcgcgctctggccgctcatggccaccaggctcggacgcgccagggtgtaggcaaaaccactgctttccagggcgttgatcaacgccttgacccggccaccgccaaacccgatgttgaaactgtcagcgctcaccggcagcttgaacacgctctctgctggggagagcaggtcggggctgccgaggaagaaattcttgcccatgccgaggatcttggtgctggcctccttgagcttggtgcggctgacttcgacgaagcggatatcggtctgtacctggctgggcagtgtcgggtcttccgagggcgacagcgattggctggtcagtgccgaggtagccttgcccttgacgaacaccatgctctggcgcggcgcggtcgagcagccggtccacaccatcaggcttgtggcgccgctgccgacgccggtcagcaggaagttacgctcgccattgacccgcacatcggcgatcttcgggtcaccaatggccaggcgcgtgatcgccactgacgattgcagctcggtttgcaagccttcgcccacctcgaccacggcgggcaactggcccaaggtgctgcaattgccaggtgctgccattgccaggcccacgggcaggcacggtagcatcaaggtcaaggccaattgagcgtagcgtgggctcattcaaagcatccttgttcaatcaggggtttgttgggccgccgaagcgccacgaatcacttcgacgccccgacgctggccggtgtcggcaaccgtgggggcgacttttttcggcgggccggtgagggccagttgggtgaataggtagaggtcgcggttggcgctttgcactttgtccggcatgtcgctttcgccggcccaatagcggctgagcaactgttcgtcggcactgcgcacagccaggcgcagcgtgccggcttgggaggcgagcatcagccggctcagcaacggttcgggcaccgccagcacgacactgcgcgctgcggtacgccgttgggcagcttgggcgcgctcttcggcggtggccggtgggggcactgccggtgtgccgtcgttggccagccccaattggtcgccgacgctgagcagccgaatcgcgggaatgatcacctgcgccgattgctcggcattggcgttgtcctgacgcaggaacagaaggacgtcgacgtaatcgccggggctcagttggccgccagcaccgatgacctcatcgacggcgaccgccagtgcgcgttcattcgcacgaatcatgcgagccagaggcccaccggcggtgaaactttcatcgtttagccacgtccctgcacccaacgcgcgcaagggcgtacgacctatagcctggtcgaggctggtcaggctgccggccggaacggtgcgcaatttttccacggccacgtcggcagcggtaaggggggcaaaagcgggcaccgcgtgtaccagtaccaccaccggttggcgggtttggtcttccacggcagtcagggttttttcaacggaaatgacaggttccggcgatggggccactacggattccggaggacgactcagcaccagcccccaataccctgcaattaaagctgcgacaagcagcaagccagccaggaccatgctgatgcgactgttcatgacggctctccctatcccgttgcactgcttatgcccgttaatccaaacgagttaatttcgcaacttagctgtgatgaacaactaacgatttggctatttgaaggtagctcagctaggacgaaatgccattaccgtatgaaaaaattatctgtaggctacatctgacccccgtaaaatcggatttggggcggcagcgccgcgactaatactttgtgattaattcgttcttacagttgtgagtgtcaactttgttgacaatgctctagtggcacacggcaatcatcgtgcgggccagcagtaacggcgctttgtggcgcatgaaggagaagtcttatgatccttgatctgttcttaaagttttacattcacgctcagttattcttgcgtcgcagagacggagcatcagccattgagtatgtgattatcgtggcgatagttgcgttggtgatcattgggttcggtactgggctgggcgataaaataaaaggcgttttccagaaggtgtccgatgcactgccggcggcgacataaccgtaagtactgtaggttgtcgtttcgatgatctttttaatcaggtactgcccatgagccccccgtcgtcagcccgccaacaaatcctattggtggacgacgaggaggatgcgctggtcgagttagccgaatccctcgaaaacgagggattcgtctgtttcacttccacgtccgtgactttcgccctgcaagaattgacacttcatcctgatatagcgttggtcatcactgacttgcgcatgcccgaggaaagcgggatttccttgattaagcgcctgcgcgaacacacatcgcgctcgcatttgcctgtgatcgtgatgtccggccatgccgagatggatgatgtcagtgacatgctgcgtctgcaggtgctggatctgtttcgcaagccgatctatctggtgcgcttgatcgataccctcaacagcctgtttcctctgccgaagtcccgtcggtagttggcgcgcgcagttccaaaaaaatgtgggagggggcttgcccccgatggcggtgtgtcagtcacagatttgctggctggcactcactcatcgggggcaagccccctcccacatttttagttaaggcatcggctgggtcagagctgataactgaaactcaacgtataccgcggccgccggttgtagctgtccagggctatgtccgacatcggtttggccgcttctagggcgatgttgtagtacttgttgtcgccaaagcgcaggcccacggccgccgatgacatgtcgctggccttcaccggcagctcgttgaaccaggtcttggcgcggtcgagcaccacatagggttgcaggactttcacccagtcaccggcgcggttgtagctgtagttgacctcgtaggccgcgccccagcccttgtcgcccgagccttggtcatcagggtagccgcggccgaagttctgcccgccgaaggtggcgcgctcgctgtcgggcagggtgtcgttactccagtagaaggctcctgaaagcacgccttgccagttatcgaagaacttgttgctttgcaccccggacagccgcaggcggaagaagtcgaggtcgggctttgccacgtccaggtcactgcgggctttggcgcccaagccgtcgataccccggtacaagccgccgctgataatgcgcaattgccgcgcatcagccttgcgccaatcaccctcgaacgccagcgcacgcaggttcgattcgatatcaaaacgcagcgggtagcccaccagtttgtagcgggtggtctggtccacggcgtacaggcgcgtacccagggtcagcgactcggtgggcgaggcaatcagcgggtggctcaggccaatggagtagcggtccacggactggtgcggcttgagttggaagccgccgtccagttgcacattggcattggggtcggcgcggtaacgttcggcggccagtgcgaactggctgccttcggcattgatgaactggttgtagtccacgcggtagtaatgctctttatcttcgcccggcgggaacaggccgctgacggtgagctgttcgcccaggaaggtttgcgaattgctggtggcgctgagcaacgcctgggtgccgccacggcttttctgcaccaggctcatgctggtggtgaagggcttgcggctggcctggatctgcatgtgcgtggcgccatcggtggtgcccggcggcggcacttgcgcctgcacggtgaggcccgggatgcggctcatcagagtggtgtagcgttcgaaggttttgcgggtcagggggcgttcggccaggagtttattcgccagcttgtcgacgtaggccgacaccgggccgatgtcgccggtctgctggtaatccttgatgtaaccctccaccaggaccacgcggaccaggccgttttcgaagttttgctgcggcaggaacgcataggacagcaggtagccgtcttgctggtagcggcgggtgatgccacgggtggcgtcgatcagttgcgcgaggttggtctcacgtccaatcaacggcgcgtaggccttggccgtctcggtgagcgggtagatcgtcccgccttcgatttgcagcttgcggatggtgaccttggtgtccatcagcagcggctggcccgccgtcggcggcgcctcgggcacctgggtttgcggggtggccgggcggtaggcgtcggcgggcaggttggggaccggcagggtgcggattgtgtcgttactgttcaaaaagctgggaaggggctcggcctgtacgtaggcactgagggtcatcaataacaacggtgtcaacacgcgcataggacactccatggtcaactgcagcagcgcttcgggcccgccgggttctgggacgcggttcgggagggcggcggttcatcacctatgtcgccgcccataaaaaagacgagagacttatttagggtctctcgtctcaaccaagcgtaggcgctgtaggggaggccgtctaatcggccaggtgcaattctattttccggtcaggccgttcaacaaaccgccaagaccgcccgttgctgtggtgccgccggttgttgtcgttgcagtaccggtggttgtggtgctggcgccgacgttcaggccgccaagcaggccaccgctggtgccgccggtgccgccggtgaccaggccacccaccgagctcacggtgttgccgaccgccgtaacggtggtgccgagggtgttggtgaccgggttggcgttggctgtggtgaggttagtgcccaggctgctcacagcgccgccgacttgtgttaccaggccgttgactggagcaccaacgccagtggtggtaccaatgttttgcgtcagtgcagtgacgccggaagtcactgggttcaaagctgcgccgacattggttgcgactgctgcgaccggtgccgtggcgccggtgttggcgacgccggtaccacccagcacggtgcctacggaggcgatggtgttgcccagcgcgccgccggttacgccggctgcactgacggtgccgttggtgttgcccacattcaggccagtacccacgttacttaccaggccacccaccagttccggtatgccgggggctgccgtgccacccgcaggtgcgacataaccgccggacttatcgagtgtgcccccgacgccagtcagcacgctgccgaccacgctggtgacagggttgccggtgccgccagtgctggcgacttgggtacccaggctggtgaccgtcgagcctactttgtccagcaggccattgacgggagtgcccaggccggttgcggtgcccagattgccggtggtgttttccaccagcgacaccacaggcaccactattttgccacccagggtgttggtcagcgaacccagcgggccagtggtgctggcggtgctgagggtatcgccgagcatggtcaccgtggtgccgactttatcgactacgccgccgaccgcaccgccgacaccgccggtcaagccaccgaccacggggacgccgccgagggtggtcgacagcgattggccggtggtcgagaggccgccgcccaggtcggcgacgccattacctacgcctgccacggtgatgcccagggagttgctattggtgcccagcgagcccaggccggtggtcacgccggtaccgatgctggtgacagcagtgcctgccgaggtcaccaggccgccagcggtaacgccgacgacgggtacaccgttcaaggtcgagccaagatcacccacggctgcgcctacattgcccacggtggtgccgagggtgccagcgatctggccggtgatcagtggggtggttgtcgagccagttccgccgccagtaccaccacccgttccgccggtgccgccacctgtgccgccagtgcctccgccggtcccaccagtaccgccacctgtgccgccagtgcctccgccggtcccaccagtaccgccacctgtgccgccagtgcctccgccggtcccaccagtaccgccacctgtgccgccagtgcctccgccggtcccaccagtaccgccaccggttccacccgtgccgccgcccgtaccacctgtcccgccgtcagtgccgccagtgccgccgccggtcccacccgtgccgccgtcagtgccgccagtgccaccaccagttccgcccgtgccgccgtcagtgccgccggtaccaccgccagttccgcccgtgccaccgcccgtgccgccgtcaccaccacctgtgcctgcacctgctccggcatctggtgaggacgctgccacgctggatttatgcccgccacctccgctgctgcagccaccgaggctcaacgccatgatcagggccagagcggtacttgctttccaaaacactacttgagttttcatgattgagttccttgcacctggtacaaccttggttgtttcaaaccctcgttacttcttggggtagcgataggtttgtccgtgtggttatcacaggcccaggcgctctttcgtgcaacgctcaacttggtattaacgatttatatagataaggtcttagtcggcttaacgactaatacgaaaggtgtaatagaaaagactttgataaaacttaaatcttttaaatcagggagttaaataaaaaaacggacctcgtgaggtccgctataactttgggtgtatatatacaattaagcagggtatttcaggcgatcggctgccacttgccgagcatatgctgaatgtcgcccgcgccttggagtaccagctcgccactggaaccggcagtgctgctcatcaatatcacttcactgggcaggcgcacgggcttcttgaactcgacttctatctcaatattggcagccggcagatgtgctcccagcgccgccagggtgcgcgccttattccacagcccatgggcaatggcctggggaaaaccgaataacttggccgtcggcgcactgaggtggatcgggttgtaatcgcccgacacccgggcatagcggcggccgatatcggcaggcgctttccagcgtgtcagctcgctggtcgggccaggggccaggaaggttttatccacggcttcgccttcaagcttcacgccgcgacatagcatttggctttcggcctcccagagcagcccaagcgcatcctcgaccacggtcacaatgtcaaaggtcgcgcccttggcgtggggcttcaggttatgcgcatagacgccgatgctcaggtcgcccacgccacccaaggggcgatgaatgcggatgcgattgctcaggtgaaccagccccagcaaggggaacgcaaacgccttgtcagtcagcaactgcatctgcaggccgaacgccaggatatgcggataggtcgccggtagcatcgggccgtcggcaaacccgcagacctttcggtaagccgcgacggccctggggttgacgctgacccggcaacgcaagccgtgttcgggcaaggtgctgccggtgatcttgcgcttgagcgccgctcgccaatacaacggcagtagagagggcgaactgtctaaggtgtgccattgcatgtttacgctcccagaagactttgcccacatacccgcagcgcttggccgctgaccgcaccggaacccggctgaccgagccaggccaccgcttcggccacgtcctggggcaagccaccctggcctaatgaactcatgcgacgcccggcttcacgtagggcgaacgggatatgcgcggtcatctgggtctcgataaagcctggcgccacggcattgatgctgattccgcgttccttcaacaggggcgcccaggcctgggccaggccgatcaagccggccttgctcgcggcatagttggtttgcccgcgattaccggcaatgccgctgatcgaggccagcagcaccacccgtgcgttgtcatgcaggctgccgctgtcgagcagggccttggtcagcacctgcggggcattgaggttgacggccagcacggcgtcccagtattccggggtcatgttggccagggtcttgtcgcgggtgataccggcgttgtgtaccaggatatcgaggccgtcgggcaggtgttcgaccagttggttggcggcgtcttcggcgcagatatccagtaccaccgtgcgcgcattcaagcgcgcagccagggcttcgagatcggccttggcctggggcacgtcgagcagaatcacctcggcaccgtcgcgggccagggtctcagcgatggaagcaccgatgccacgggcggctccggtgaccagggctttgcgccccgcgagcgggcgcgtccagtcctcgaccggggtgtcgcaggccgccaggcggatgacctggcccgagatataagcgcttttcggcgacaggaaaaaccgcagcgcaccttccagctggtcctcggcgccgtcgcccacatacagcaattgcaatacgccgccgctgcgcaactccttggccagggagcggctgaaaccttccagggcatgctgggcgctggcagcaaacggatcgctgaggctttccggcgcccggccgaggatcaccacgtgggcactgtgatcaaggtttttcagcagcggctggaagaactcgcgcagttgcttgagctggtcggtgtgctgcaagtggctggcgtcgaacaccaccgccttgagcttagggccgtgcccggggatccacgcggttgctgtcgaggcttcggtgccgtagctgtaaaccgcgtcggtgagtcgattggcaaacgccagcacctgggtcgtcaacgagcccccgccgagcagcagtgcaccctcgaccgggcgcagtcgtccggcctgccagcgttccaggcgtaccggcgacggcaggccaatggcggcgaccaggcgatggccgaggcttgagttggcgaagtcgatataacggtcagacatggaacgctctccgaaggctggggttcaaagggttgaccaccctggggtggcagtcgttcgattgagcctaggctaggcttgatgattccacccaccttcaaaagggagctttccatgactcaattgcgccgtgtagcgatcattggcggtaatcgcattcctttcgcccgctccaatggcccatacgccacggcgagcaaccaggcgatgctgaccgccgcgctggagggcctgatcgagcgctacaacctgcacggcctgcgcatgggcgaggtagccgccggcgcggtactcaagcactcccgagacttcaacctgacccgcgaatgcgtgctcggctcgcgcctgtcgccgcaaacccctgcatacgatatccagcaagcctgcggcaccgggctggaggcggcgttgctggtggccaacaaaattgctctgggccagatcgaatgtgggattgccggcggcgtagacaccacgtccgatgctccgatcggggtgaacgaaggcttgcgcaagcttttgctgcaagccaatcgcggtaaatccatggtggataaactaaaaaccttgttacaacttcgtccccaacatctcaagccggaactgccgcgcaatggcgaaccacgcaccggcttgtccatgggccagcattgcgaactgatggcgcagacctggcagattcctcgcgtcgaacaggaccagcttgcgcttgagagtcatcagaaaatggccgcgtcctacaccgaaggctggcacaacgacttgctcacgccctttcttggcctcacccgcgacaacaacctgcgccccgacctgaccctggagaaactcgccagcctcaagccggccttcgagcgcagcgcaaagggcacgctcaccgccggcaactccacgccgctcaccgatggcgcatccctggtgctgctgggcagtgaagcctgggccaaggagcgtggcctgccgatcctggcgtacctgcgcgatggcgaagcggctgcggtggatttcgtcaacggtgccgagggcctgttgatggcgccggtgtatgcggtgccgcgcttgctggcccgcaacggcttgaccctgcaggactttgattactatgagatccacgaagccttcgccgcccaggtgttgtgcacactcaaggcgtgggaagatgcggactattgcaagacccgcctgggcctggatgcgccgctggggtccatcgaccgcagtcggctcaacgtcaagggcagttccctggcggcgggccatccgtttgccgccaccggcgggcgcatcgtcgccaacctcgccaaactgttggatgcggcgggcaaaggtcgcgggctgatttcgatctgtgctgctggcggccagggggtgacggcgattatcgaacgctgattaacgacaaaattggcccattgcatgcattcttgagtggtcagaggtcggtagcctctcccaccggcgagccgattgccgtataacgagtgccacacgcgtgtttggtaatacaggacccacaataaaagctgatgaagactcctaaacgcattgaacccctgatcgaagacggtctggtcgacgaagtgctgcgcccactcatgagtggtaaagaagcagctgtttatgtggtgcgctgcggcaacgaattgcgttgcgccaaggtttacaaggaggcgaacaaacgaagttttcgtcaggcggccgagtaccaggaaggccgtaaggttcgtaacagccgccaggcccgggccatggccaagggctccaagttcggcaagaaagaaaccgaggacgcctggcagaacgccgaagttgcggcgctgttccgcctggccggtgccggcgttcgcgtgcccaagccgtatgactttcttgaaggcgtgctgctgatggagctggtggccgacgagtacggcgatgcggcgccgcgcctgaacgacgtggtgctggagccggaccaggcgcgtgaataccacaccttcctgatctcccagatcgtgctgatgctatgcaccggcctggtgcacggcgacctttctgagttcaacgtactgctcacgccaacgggcccggtgatcatcgacctgccccaggcggtggatgcggcgggcaacaaccatgcattcaacatgttggagcgcgacgttggcaacatggcttcctacttcgggcgctttgccccggagttgaagaagaccaagtacgccaaggaaatgtgggcgctgtacgaagccggcaccttgcacccggccagtgtattgaccggtgagttcgacgaaccggaagagctggcggatgtgggcggtgtgatccgcgagatcgaagcggcgcggctggatgaagagcgtcgccaggcgattcgtgcggcggatgatgcgccaccgagcaaagtgccggacgaaccaccgccgccgccttggatgcagtgatcttcgggtagatgaagatcaaaatgtgggagggggcttgctcccgatggcggtgtgtcagcgacagatgtgttgactgacactccctcatcgggagcaagccccctcccacatttggatttgcgtgtagccagttagagcatcaggcgcagcagttgcccgctgccaactccttgagtatcgggcagtccggtcgatgatcgccctggcagtgctccatcaggtcctgcaaggtatcgcgcagttgccccaattcgcgaatcttgtgattcagctcgtcgatgtgctggcgcgccaaggcttttacgtcggcgctggcccgttggcggtcttcccacagggtcagcagcttgccgacttcttccagtgaaaaccccaggtcccgcgagcgcttgataaacgtcagggtgtgcaggtcgtcatggccatacacgcgatagccgctgtcagtgcgatggggcgttttcagcaggccgatggattcgtagtagcgaatcatctttgcgctcagcccgctgttgcgggcggcttggccgatgttcatgggcgttgatcctccaagtccttgggtttccaggttttcaacaacagtgcattactcaccacgctgacgctggacaaggccatcgccgcaccggccagcaccgggttgagcaggccgaaggcggccaggggaatgccgatcaagttatacacaaaggcccagaacaagttctggcgaattttcgcgtaggtcttgcggctgatctccagggccgccggcaccaggcgtgggtcgccccgcatcagggtgatgccggccgcgtgcatggccacgtcggtaccgccacccatggcgatgccgatatcggccgcggccagggccggggcgtcgttgatgccgtcgccgaccatcgccaccacgccggtttttttcagttcggcaacggcagccgctttgtaggcgggcagtacctcggcgtgcacatcgtcgatacccaaggcctctgcgacgacccgggcactgccgtggttatcgccggtaatcaggtggctgctgatgtgttgcgctttgagctgttgcacggcctccagcgcgccgggcttgagggtgtcgccaaacgcgaacaagcccaatacgcggggctgcgtgccttgctcgataagccaggacaaggtgcggccttcggcttcccaatccttggcgcgctgagccaattcgcccgcctccaagcccgtctcttccagcaagcgtcgattacccagcgccagtggccgaccgtccagcgtgccggcaatgccgcgtccggtcagggactggctggcactcacatcggccacgtccagacctttctcctggcacgcatccagcacggccttggccaatgggtgttcactgccgcgttgcaacgcgccggcctgttgcaacaagagtgcttcgttgccatccacggccgccaggtgcgcaattttcggcgcgccggaggtgagggtgccggtcttgtcgaacaccacggcgctcaccgcatgggcgcgctccaatgcttcggcatccttgatcagaatgccgtggcgcgcggcgacgccggtgccggccatgatcgcagttggcgtggccagacccagggcgcaagggcaagcgatcaccagcactgcaaccgcattgatgatcgcagtttccagggatgcgccgtaccaccaccagcccactacggtgatcaacgccaagaccaataccgctggtacaaacacctggctgactttatccaccagtttctggatcggcgccttggcagcctgggcgtcttcgaccaggcggatgatgcgcgccagcacgctctcggcccccagggccagggtgcgcaccaataaacgaccttcaccgttgatggcgccaccggtgaccgggtcgcctggctgtttaggcaccggcaggctttcaccgctgatcagcgcctcatcggcatggctttggccctccaccacttcaccgtccaccgggaagcgttcgccgggtttgaccagcaccaggtcaccgtgcttcaacgcattgatcgcgacgtcttcttcgcggccatcctgcacgcggatcgcccgttccggacgcaaggcttccagggcgcggatcgcgctggcggtctggcgtttggcgcggctttccaggtatttgcccagcagcaccagggcgatgactaccgctgaggcttcgaagtacaggtgcggcgtcacgcctggggcggcggtgagccattcatagatgctcaggccgtagccggcgctggtgccgatcgccaccagcaggtccatattgccagcgccggcgcgtacggctttccatgcggcaacatagaagcgcgcaccgaggatgaattgcaccggcgtggccagggcaaactgtatccaggcggggagcatccagtgcaggccgaagggttccaccagcattggcagcactaagggcaacgccagcaggatccctgccaccaacgcccatcgctcacggcgcaggcgtcgggcctggtcggcttcggtggcggtttcgctttggggcagggtggcggtgtagccggccttgtcgactgcggcgatcagtacgctggcgtccatctggccgagcacttcgatatgagcgcgttcgttggccaggttgacgctgacacgctgtacccccggcaccttgcccagcgcgcgttcgacgcggccggcacagctggcgcaggtcatgccgccgatgggcaagtcaaatgtggtggatccattcatgggacagtcctccaggagaagttgcccttaggatcaaccttaacctgtggggaaggtcaagcgtcttcagtattccaatgccgcaggcttgaggtacatgccgtccgggccttgagcgatacgcaatttgcgtacatcgccagccttcaaggtaatgttctgcgcgggtggcgccagcaggctgggcaggcagcctccggactgacctggtagcagcttgagacgcagcgatacatcgcccgcaggcagattgaacgaggtggcctgttcctggaacaggcgcccggccaattggtcctggatatacaggccgatctcgcagttggtcggcacctccaggcgctcgcgggaaatgatcagcaccgcataatcttcagcggcaagggcttggggcgcagcagcagacaggctcatcaggccggcaagggcaaaaaacgaccagcgcatggcgaatgctccgtggttcacagcaaggaaagttgaagcttggccgacgttgcctgcgaataccagcccggccgatttttttgaaacttgaccttgctgtcgtggcaaggttgacactgtgtcccaacctcatcaaaggagtcatgtcatgcaaatattcagtgttgaaggaatgacctgcggccattgcgttcgtgcggtgacccaggcggtacagagccaggatccggcagcgagtgtcgaagtggatttgggcgctaaagaagtgcgcgtggcaagcagcctgcccgcggataaggtcatcgaactgatcatcgatgagggctacaccgctaagctggcgtgatttttctgatcgttagcgacctaacgtaatgttcatggcacccaagcgcggctagactgtcgggctgccgactcacttgggtgtctgatgaaccttcgcataatcctgattttgggcgccttgagcgcctttgcgccgttggcgatcgatttttacctgccgggctttccggcgatggccacggcctttgccaccgatgaaaaacatatccagttgaccctggcggtgtacttcgccggcctggccattggccaattgatctacggcccattggccgaccgctttggtcgtcgcgtgccgctgctcagtggcgtcactctgtttacccttgcgtccttcgcctgtgcctacgcaccgtccctggaatggctgatcgttgcgcgcttcgtgcaggcccttggcggttgcgcgggcatggtgatttcccgggcggtggtcagtgacaagtgcgatgcggtgggctcggccaaggtgtattcgcaactgatgctggtcaccggcctggcgccgatccttgcacctttggcgggcgggttgatggtcggggtgtggggctggcaatcgatcttcctggcactgtcgttgttcagcgtaatggctgcgattgccgtggcagtcgggttgccggaaaccttcccggccgatcagccgcgccagccgttgtctggctcgttgcgccgctacggctcgctgttgtcggaccgcgtatacctcggctatgccttgaccggcggcatctcgattgccgggatgtttgcctacatcgccggctctcccttcgtatttatcaaactctacggcgtgcctgccgagcattacggctggctgttcggttccaacgccgccggctttatcctggtagcgcagttgaatgcgcggttgctggccaagcgcggcccggcgtttttgctgtcgcgcacggtatgggtctatgtggcggccgcgttaacgttgctgggtattgccgcgctgcgcaccgaggccttgtggcctttgctggtgccactgttcatctgtatcgccagcctgggctgcattttgcccaatacctcggcgtgcgccatgagcgggcagggcgcccgggccggcagtgcgtcggcgttgctcggttgcattcagttcggtgtggcggcaggggctgcgtcgttggtcggcgtgttgcacgacggcacagcgatgccgatggccatggtcatctgcttgtgtggtgtgctggcggtgacgattgcgatgtcgacccagcgcctgcaacgggcaagggccgaacaggcgcaggtctgaaatgggtcagccagcggcggagcgttgctggccgaggggaaagcggtggggcgcctggatacgggcttgcagggtttcggcaaaggcgcgggcctcggcttcactgcgaaaggtgatggctttgccgtcgagacgaacctgccattggctgcctggggattttgctaacgcttttatcaggatcttcattgctgacttcctcgcgtaaaagactcgtggcaaaggcggccaatataaacccgaatccccttaaaaatatgacaagggtcaactctcagactaatggcgtcgtccattacttacatgaataacggacgacactgacagtcgtttttttagaacccttccagcacgatcttgcccttggccttgccgctttccagcagcgcgtgggcacgccgcaggttggccgcattgattacaccgaagtgctcgcccaccgtggtttccaggatgccagcgtcgatcagttcggccacgcggttgagcaagttgtgctgctcgatcatgtccggcgtttcgaacatcgagcgggtgtacatgaactcccagtgcagcgacaggctcttgcgcttgagcttgctcacatccagcgccttggggtcatcgatcagcgccagcttgccttggggttgcagcgcctccaccagttgatcgaggtgatgctcggtctgggtcaggctggcaacgtgggtcacttgcgggtgaccggcctgtttcagcgcttcgctcagcggctggctgtggtcgatcaccaagtgggcacccagggccttggcccaggcctgggtctcggggcgcgaggcggtgccgatgactttcagcgcggtgagctggttggccagttgcgtcaggatcgaccccacgccgccggctgcgccgacgatcagcaggctctggccttgatcttccttgctttcaattatctgcaagcgttcgaacagcagctcccaggcggtgatggcagtcaacggcaatgcagcggcttcggcaaaccccaggctcttgggcatatggccgacgatgcgctcatctaccgtgtgcagttcgctgttgccgcctgggcgtaccagggaaccggcgtagaacaccttgtcgccagccttgaacagcgtcacgtcgctgccaacggcctggaccacaccggccacatcccagcccagcaccttggcggcgccgttttcgggggcgacgttctggcgcaccttggtgtccactgggttgaccgagatggctttgacttccaccaacaggtcacgcgggccggccacgggctccggcagttcgatgtcttgcagggattttgggtcgtggatcggcagtgaggcgtagtaggcaatggctttcatggtggctccggtaaagggggcgtgatgcggacttgatgtagggatcaggcgaggaatttcaggcgcttgaggtcgaaatgttcgagcacgtcagcggctttggcgcgaaagctctggatatgcgcgctctggtcatggtcggccagcgctgcctcactgctccagcgttcgagcatgtagaaggtctcggggtgttgcaggtcctgatgcaggtcgtactgctcgcagccggcttccaggcgggtcggttccagtaggccgcgcagcaagggttccagggtggcttgttggccgggtttggcgatcagcgtggcgatgacgttaaaggcggtgggcatattcaactcctggcaagtgatgacggaatgcgcagatgattggctatttccgatgcagataaaagcggctaaaacagcagtctgtttcaaccaaattttgataatggatggaagtgcatgctgcgttttgatgatttgcagttgtttgtgcgcgctgcggacttgggcagcctctcggcggcagcgcgggtcatggacctatcgcccgcggtggccagcgcggcgctcaagcgtatcgagcagcaactgggcacgcgcttgctggcgcgctcaacccgcagcctgcgcctgaccgccgaaggcgagggcttcctggagtatgcgcgtgcgtcactgggtgcgctggacgaagggcggcgccttttggccagtggacaagatcatgtcagcggcgtgctgcaattgtcggcgccatcggattttgggcgtaaccagctggtgccgtggctggacgagttccagcagcaacacccgcaattgaatgtgcgcctgttgctcggcgatcgcattgccgacctgttccgccagccggtggacatcgccttgcgctatggcgaacccgaagactccagcctgattgcgctgcccatcgccccggataatattcgagtgctgtgtgccgcgcccagttacctcgcccgccatggtgagccgcgacatctggaacaactggcccagcacaattgcctgctctacatgctcggtagccgggtgcatgaccactggggtttttacgacggcaagcgtcatgtaagcctgacggtaagcggtgaccgcttcagtgatgatgccgacgtcgtgcgccgctgggcggtggcggggatgggtattgcctacaagtcctggctggatataagcaccgacgtgctggccgggcgcttgcgcttgatcctgccggagctgcagggcgagcgcacgccgctcaacttgctgtgtgcccatcgtgcgcaattgagcaaacctatcaatctgctgcgggagatgctcgtggcacgttgtgcgatattgaccgcgcagcgaccggggcgaatggctgctaggcaatagcctgcgccacggtcggaagtttcactcatatcctgtcctgatctgcgctgtcagacgccgcggaaccgctggtctgcgcacctatactttggcctcaaccgcagcagaaaaatggtttaacagggagtgaatacatggaagcagcaccttgcatcagtcagatcgccagcttgctcgccgagcctaagcgcacggtcatgctctgggccttgatggacggttcggcgaagtcttcagaagagctggcgaccctggccggactatcgccggcatcggccaatgcacatttggcgcgcctggccggcagcggcctgctgcgaaccgaggctcgacggggcaagcggttgtttcgcgtggcggctgcggatgtcagtgtcgccattgatgcgctggccagtaccaccatggccagcgcggcgcgcagcacgccgaatgccttgccgccggcgcttatggcgccaccgctgctgcggcgtgcccgcctgtgtcacggccatctcggcggcgagctggcggcagggctgtaccggcggatgttggaggcaggctggatccagcgccatgagcagcgtaacgaggtcacggtcaagggcgcgcagtatttggcaggcctgggcatttttacccaggcactggcggcgccgttggcctgcgattgcttcgactggagccagcagcaaccgcatctgggaggggcgctgggtgcggggttgttgcaactgttcctgcagtcgggctggatcagtgtggtcaacgagtcgcgggctttgcaggtttccgatctcgggctcgcgcaaatcaaccggctggcggcagtgtaggcgcctcgtcagcggttcgcgtcgttcagggtttcagtcaggtcgcatccagcaatagccagggataacgatgtcgcacactcgccgagggatttttcacaagggggtgtggcatgggtatacagggctatagcgcagcggaacggttggagcggctgccgatcagtggttaccaccgaatcattttcatcatcatcgccttggcgtttttcttcgactccatggacttggcgatgatgaccttcctgttgggttcgataaaaaccgagtttggcttgagcaccgcccaggccggattactggccagttcgagctttttcggcatggtggtcggcgcctcgctctccggcatgctcgccgatcgcttcgggcgcaagccggtgttccagtggagcatcgtattgtggggcgttgccagttacttgtgttccacggcgcagacggtggagatgctgacgttgtttcgtatcctgctgggcattggcatgggcatggagtttcccatcgctcagtcgatgctgtcggagctgattccggccaagggacgcgggcgctacatcgcgttgatggatggtttctggccgttgggttttgtggccgcaggcgtgctgtcttacttcctgttaccggtgattggctggcgcgacatcttcctggtgttggcggtgccggcggtgtttgtgttggccatccggttctttatcccggaatcaccgcgctggctggaacaggccggaaagcatgacgcggcggacaaggtgttgctgggcattgagcagaaggtacgcgagtccctgggccgggctgatttacccgagccggttgccctgccgagggtcgcgactgtaccggggactttcttctccgcgttccagcagctgtggtcgacgcagtaccgccaacgcacaatgatgatctggagtgtgtggttttttgccttgctcggcttttacgggctgacatcgtggttgagtgcgttgttgcagcaatcgggttttgccgtgacccagtcggtgtattacaccgtgatcatttccctgggagggatcccgggcttcctgatggcggcgtggctggtcgaacgctgggggcgtaagccggtgtgcatcgtgacgctgctgggcggcggggtgatggcgtttttgtatgggcaaagtgcggtgtttggcggcaacgtcggcctgctgattacttcggggctgctgatgcagttcttcctgtttggcatgtgggccgtgctgtacacctacacgccggagttgtatcccacttctgcgcgggcgacaggttctgggtttgcttcggcggttggccgggttggctcattgctcgggccgttggtgaccgggctggtcttcccgataacagggcagggcggggtgtttgccttgggcgcgctgtgctttgcagtcgcggcgctggtggtgtgggtgtttgggatggagacgaagggcaagacgttggaagagctcacccaagtctaaagctcaatacaaaacctatgtgggagggggtttgccccctcccacatttagcatgcattcatttaatgatggctggttatggctttacgagccgtgcatccaggctgttttgcgccaggcgcttggcctggtcctgggtcatgcccagggaggtgtacagcgcgtggaagttctcggtgacatagccgccgaagtacgccgggtcatccgagttcacagtcaccttcacgccacgctcgagcatgtcgaggatgttgtgctgggccatgtcgtcgaacacgcagagcttggtattggacagcgggcacacggtcaacgggatctgttcgtcgatgatgcgctgcatcaggcgttcatcttcgatggcacgtacgccatggtcgatacgttggatcttcagcaggtcgatggcttcccagatgtactcgggcgggccttcttcaccagcgtgagccacggtcaggaagccttcgtgacgggcacggtcgaaaacgcgctggaacttgctcggtgggtggcccatttccgagctgtccaggcccacggccacgaacgcatcacggaacggcagggcctggtcgagggttttctcggcttcggcttcgctcaggtggcgcaggaagctgaggatcaagccgctggtgatacccagttgctgctcgccatccttaagtgccgcggcgatgccgttgagcaccacttcgaacggcacgccacggtcggtgtgggtctgcgggtcgaagaagggttcggtatgaatcacgttctgggccttgcagcgcagcaggtaggcccaggtcaggtcgtagaaatcctgggacgtgcgcagcacatcggcgcctttgtaatacaggtcgagaaactcttgcagattattgaaggcataggccttgcgcagggtttcgacgtcgttccacggcagcgctatcttgttacgttcggccagggcgaacagcaactcaggctccagcgaaccctccaggtgcaggtgcaattcagccttgggcagggcgttgagccaatcgtacatttttaaaatctcatcaggtgcaatggcggcattctacaggccatggctgaaataatcggcaaaacctgaccagcaggagagtatttgtctcacccacgcaaggttgatgtgaactaaggtgtaacgaaacgttagcggcttggcgcagtctgtaccccatcaatgactgattcgccgtatgaaaaggcccggaatgctcacatccctcaagcaagaaaaattcatgttgctggcgctgattgccgccattgccgcctacccgctggagcactggatgctccacagcgggcaactggtggcgctgctggcaggcttggcgctgatcgcctttatcgtgatggcttcgatgcgcgtcgcgcaccatgccgagcaactggcggaaaaggtaggtgacccctacggcaccatgatcctgaccctcgccgcggtattggtggaagtggtgatcctggcgatcatgatgagcaacgagccatcgcccacgctggtgcgtgacaccatctactcggcggtgatgctcgatatcaacggcatcctcggtctggccgcgctgatgggcggcatcaagcatggcgagcagtcttacaacgatgattcagcacgcacctacagcgtaatgatccttaccgctatgggtgtgtcgatggtggtgccggagtttatccccgaagcggattggaaaatctactcggccttcaccattggcgcgatggtggtgctttacaccttgttcctgcgcatgcaggtggggccgcacagctactttttcagctacagctacccggaaaagcgccgcaagaaaactccggaggaggagcaggctccgccggtcaacctggcgttttccatcggcacgctggtctttggggtaatcgtgatcggcgcattggccgaggtgatgtccaagaccctcgacctgggcctggaaggcaccggcgcaccgccggtaatcacggcgattgtggtggcggctatctctgccgcgccggaaatcctgacggcactgcgcgctgcgttggctaatcgtatgcagtcggtggtgaatattgcgttgggagcatcgttgtctacggtgatccttacggtgccggtgatggaggccatggccctgtattccggccagccgttccagatggcgatgacgccggtgcagacggtgatggtgtttatcacgctgattgtcagtgcgatcaacctcaacgatggcgaaaccaatgccattgagggcatgacccattttgtgttgtttgcgacctttatcatgttgtcgctgctggggctgtaaccagacttcgagaacaccccagaaccaaatgtgggaggggcggtgcgatggttcgacttgctcccgatagcggtggatcagccaacttatatatgactgaaacacctccatcgggagcaagtcgaaccgtcgcaccgcccctcccacattttggaatgtgttgggctcaggtgccggcgatgagttggcgagccgcctgagtgtgatcggcgatcaagcctttcaggtccaggccttcgacttggccgtcgattacccgccactggccgccgaccatcacccgatccgcccgatccgcaccgcacaacagcaacgctgaaatcggatcgtggctgccggaaaagcgcagttcgtccagcttgaatagcgccaggtcagcctgcttgcctaccgccagttcaccaatatccgtacgccccagcaactgcgccgaacctttggttgcccagcccagcacgctttctggggtgatcttttctgcgccataacgcaggcgctgaatgtacagagcctggcgcgcttcaaggatcatgttcgacgcgtcgttggaagcggaaccgtccacgcccaggccgatgggcgcgccggcggcaagcagatccaaggtcgggcagatgccggaggccaggcgcatgttcgagcttgggcagtggcagatgccagtaccggcggcgcccaggcgtgcgatttcatccgggttgaagtgaatcccatgggccagccaggtgcgtgggccgagccagccgacgctgtcgaggtagtccacggtacgcaggccgaaacgttgcaggcagaagtcttcctcgtcgagggtttccgccaaatgggtgtgcaggcgtacatccaggcggttggccagctcggcgctggcttgcatgatctcgggggtgaccgagaacggcgagcacggcgccagggctatctggatctgtgcaccgtcgccacgctggtggtattcgcggatcaggcgctggctgtcgtcgaggatcacctggccctgttgtacggtctgctgcggcggcaggccaccatcggcctcgcccaggctcatggaaccgcgggtgagcatggcgcgcatgcccagttcgcgcacgctttctacctgcacatcaatggcgttttccaggccatcggggaacaggtagtggtggtcggctgcggtggtgcagcctgagagcagcaattcagccaaggcgactttgctggccagggcaagtttttccggggtgagccgtgcccataccgggtacagggttttcaaccagggaaataacggctggttgaccaccgggccccaggcgcgggtcagggtttgatagaagtgatggtgggtgttgatcagcccaggcaagaccacatgctcgcgagcgtcgaacatctgtgcacagggttgtgccggttcttggtcttgggccagcacttcggtgatcacaccgtcttgcagcaccaggccgccgcgggcatcgaggccattggcagtgaaaatcgcgagagggttttttaaccagatacgggtcgcaggcattggccggctcctctgaatgatgggttcaggtttgccagctcagtgttgccctgtctgctgatccagggtcgccggggagggcgaggtgggcagtttacctctgtaggagcgagcttgctcgcgaaaatcgtcaacgatgacgcgggcagtctggctttaagcagtgcctgggcgttcttcgcgagcaagctcgctcctacagttgggggggttaccaggcgatggtgtcgcccttgtagtccacgaagtggtggccgcctttaccggtgtaggcattcacctgatccaccaggccacgcacgctggtgtcgacgtcgatatgcgcattttcgccgcccatgtcggtcttcacccagcccggatgcatcgacagcacggtcagcttgtgatcgcccagttgggtgataaagctgttggtcatcgaattgagtgcagccttgctggccttgtacagcgccagatccgaaccgtcgggaatggtcacgctgcccagtaccgaactcatgaaggccagcacaccggtgtctttgcggatctgcccgacaaagcgctgggccaggttgatcggtgccacggcgttggtgaagaacaactggccgacttccgccagggtggcgtggccgggctcctggttcgccgggcccttgacgccagcgttgacgaacagcaggtcgaaggtgcggtctttcaggcgttgggccagggcgatcacggcttgctggtcgtccatgtccaacttctcgacctgcaccggccccacggctttcagcgcatcggctttgctcggatcgcgcacggtggcggtcacgtcccagccatcctggagcaattgcttgaccaggccaaggcccagcccgcgtgaggcgccgatgatcagtgcggtttttggcgtagacatgaaaggcttcctttgaaatcgcggttcagggagttcagcacgtaacagtagcagtttcagcgttgcagcaggatgcgcccacggctcaggtcggcgagctgggcttgcagggtgtcgatgtgtgcctcccccagcgcaagctgcagctccacgccgttggcggtgaaggtttcttccaccaccaggcctgcgagttcagcgacacgcagcttcaccaggttcagctcggaaaacccacaggcgcagctcagtggcacacggctgaccagttcgatgcgctcggcattttgcaggcatttgtttgcaccgccgccataggcacgggcgaggccgccggtacccagttggatgccaccgtaccagcggattaccagcaccgcgacctgatcaaagccctgtgcctcgatagccgcaagaatcgggcgcccggcggtgccgccaggttcgccgtcatcgttgctgcggtattggtcggccagcttccaggcccagcagttatgcgtggcgttcaggtcgctgtgttgctcgaaaaaagcctgggcgtcctgcgggctggtgatgggtgccgccagggtgataaagcggcttttgcggatttcttcacgaaattcgcaaaagcctgtcagcgtaaaagacataactcgcttcgtttattgggctggcttgatgccgcagcctttgaggatgatctggatcagattggtgccagcgtcttccatgtcctgcttggtcagcttggtgcgaccggtgacgcggcagatctgggtggcgaagtcggcgtagtgctgggtgctgccccacagcaggaagatcaaatgcaccgggtcgacggggtccatcttgccggcgtcgatccaggcctggaacaccgccgcccggccactgaaccaggcgcgatagtcttggctgaaatattcggtgaggcattcgccgccgctgatgatttccatggcgaagatccgcgaggcttgtggctggcgtcgcgaaaattccattttggtgcggatatagcgcgtgagcgccacggctgggtcgtcctcggcagtcagcgcgttgaaggtgctgtcccacagttcgagaatattgctgagtaccgcgatgtacaggcccagcttgttggtgaagtagtagtgcaagttagccttgggcaacccggcactggcagcaatggtattcatgctggtgcctttgtagccatggcgggcgaattcatcttcagcagcctggagaatcgcttgttcgttcttttgccgaatgcggctggcgggtttaccggcgtggttgctgtgggcaggaacttcgaggctcatggaggtttccgtgctgatcgatagagacgacgtgtgcacagataacccaccctaaagccccagacaagtcccgatgcaataaaaccgtcaaagcggttccaggctgtcgctttctggcgtgtggtttgcggcagtggtgctcggcttggcttccggcagtaacaggcacaagaggatggcggtgaggccgccgctggtgatggcggagtcgaacagattctgcaccagtgttggcatcaagtgcagcaggttgggctgggcagcgatacccaggccgacgccgaacgaggtggcgatgatcaacatgctgcgtcggtccagcggcgcctgggcaagaatacgcacgccggcagcggccacactgccgaacatcaccagggtcgcgccgcccagcactggtttgggaatttgctgcagcacggcgccgatcagcggaaacaagccgagacagaacagcaatgcgccgatatataagccgacgtaacgactggccacgccggtgagttggatcacgccattgttctgggcgaaggtggtattggggaaggcgctgaaggtggcggcgatcatgcagctcacgccatcgcccagcacgccgcccttgagtcggcttatataagaggggccgctgatcggctggcgggcaatcatgcaattggcagtgaggtcgccgacggtttcgatactgctgatcagataaatcagcgctatcggcaggaaggcgctccagtcgaagttgaaaccgaagcggaacggcgtaggcaggctgatcaggggcaggtcaggcagggcctggggagtgagtttgccgctgaaccatgcggccaggctccccagagccaggccgatgatgatcgccgagaggcgtacccatggggtgttggagcggttgagcagaatgatcgtcagcaccacgaacaagccgagcgccaggttggcgggggcgccaaagtccggtgcattgaagccgccgccgagatcggtgatgcccaccttgatcaggctgatgccgatcaacgtaatcacaatccctgtaaccaggggcgtgatgactcggcgcagttggccgataaagcggctcagcacgatctgtaccgctgcgccgaagaagcacacgccgaagatcatcgccagaatatcttccgggctaccgccccgttgcttcaccagaaagcctgccgacaacaccgcgccgagaaatgcaaagctggtgccttgcaggcagatcatcccggcgcctataccaaacggcctgcgtgcctggatgaaagtacctacgcccgagaccatcagcgccatgctgatcaggtagggcaagtgggcggtgaggccgagagtagagccgatgatcagcggtggggtgatgatgccgacgaacgccgccagtacatgttgcagtgctgccaacagtgcgggcagtggtttcgggcggtcgttgaggccgtagatcaggtcgctggagctggaggattctgggggcatggcgggttaactcgaggcggacggttcaaggtccctgtgccttgcaaaaagctgtccacctgctcagcttttaccctgaagcccgagttagcgggttgcggccaggctttccaggaagctttccagcaccaaatgagggcgacgacccttgcgtgtgaccgatgccaggctcaaatcgtaaaaacgtgtagctggtttcagtgcgcgcagtcggccttgttgcacccacaagctggcgtagtggtcgggcaagtagccgatgtagcggccggtaaggatcaggaacgccatgccttcacggtccgaagcgctggcggtgcagtttagcgcctggtagtgggcctggatctgtgcgggcaggcggaaggtgggagcgatggcgtcctggtcgtcgatgcgttcgtcttccagctgcttgttgtcggcataaaacaatgggtggccgactgcgcagtagagtagcgagcgttcgctgtacagcggctggtactccaggcccgacagcgcgctggcctggggcacgacgccgacgtgcaggcgcccgtcgagcacaccttgctccacctcattgggggcgatcatgcggatctggatttgcacgtccgggcctcgctccttcaactgtgccagtgcatgggtgatgcgcatatggggcagggtgacaaggttgtcggtaaggccgatgatcaattcgccgcgcaggtgctggtgcaggccgttgacctcagtgcgaaagctttccagggcactcaataattgcagggctgactgatagacctcgcgaccttcctcggtcagtgaaaacccggcgcggccgcgttgacagagccttagcccgaggcgctgctcaaggtcgctcatctgttggctgatcgccgagcggccgatgccgagcacggcttctgctgccgagaagccgccgcactccaccacgctgcgaaaaatgcgcaacaagcgaatatcaaagtcgctgacttgcgccaaagggtcgggacgacggctgctcatagtttagtgaagtcctgactgaaggttagaagagttggatttcatcgactttagccccgtggcaatttagctgcaacaaagcttttccgatcccgacgctgccttttgccttgcgaggttttgctgatgaacatgcccgaaaacgccccatcgtccctggccagccaactgaagttggacgcgcactggatgccctacaccgccaaccgtaacttccagcgtgacccgcgcctgatcgtggccgccgaaggtagttggttgactgatgacaaggggcgcaaggtctacgattcgttgtcggggctgtggacctgtggcgccgggcatacgcgcaaggaaatccaggaagccgtggccaagcaactgggtaccttggactattctccaggtttccaatacggtcatccgttgtctttccaactggcggaaaagattaccgacttgaccccaggcaacctgaatcacgtgttcttcaccgactccggctccgagtgtgccgataccgcagtgaagatggtgcgcgcctactggcgcctgaaaggccaggccaccaagaccaagatgatcgggcgcgcacgcggctaccacggtgtgaatatcgccggtaccagcctgggcggcgtcaacggtaaccggaagttgtttggtcaggcgatgatggatgttgaccatctgcctcacaccttgctggcgagcaatgcgttctcccgtggtatgccagagcagggcggtattgcgctggccgatgaattgctcaagttgattgagctgcatgacgcgtcgaacatcgcggcagtgtttgtcgagccgatggccggttccgctggtgtgcttgtgccgccacagggttacctcaagcgtctgcgtgagatttgcgatcagcacaatatcctgctggtgttcgacgaagtgatcaccggtttcggccgcaccggctcgatgttcggcgccgacagcttcggcgtgaccccagacctgatgtgcatcgccaagcaggtcaccaatggtgcgatcccgatgggcgcggtgattgccagcagcgagatctatcagaccttcatgaaccaggcgactccggagtacgccgtggaattcccccacggttacacctactcggcgcacccggtggcttgcgcggcgggcctggcggcattggacctgttgcagaaggaaaacctggtgcagagcgtagccgaagtcgcgccgcactttgagaatgcgctgcacggtctgaagggcagcaagaatgtgatcgacatccgtaactacggtctggccggtgcgatccagattgccccgcgtgacggggatgccatcgtgcggccgttcgaggctggcatggccttgtggaaagccggtttctacgtgcgctttggcggtgacaccctgcagttcgggccaacgttcaacagcaagccgcaggatctggatcgtctgtttgacgcggtcggcgaagtgctgaacaagatcgactgatttctctttctatatagaacaatttttcaggagccctgcatgagccttatccagcatttgatcaacggccagttggtcagcgacagcggccgtaccgccgatgtgtacaacccatccactggccaggtgattcaccaggtgccgttggccagccgcgaaaccattcaaagtgcgatcaactcggcaaaggcggcgttcccggcctggcgtaatacgccgccggccaagcgtgcgcaggtgatgttccgtttcaagcaattgctggagcagaacgaagcgcgtatctcgcagttgatcagcgaagaacacggcaagactttggaagacgcggcgggcgagctcaagcgcgggatcgagaacgtggagtacgcgtgctcggcaccggagattctcaagggtgagtacagccgcaacgtggggcctaacattgatgcctggtcggacttccagccgttgggcgtggtggcggggattacgccgttcaacttcccggccatggtgccgttgtggatgtacccgctggcgattgtgtgcggtaactgtttcatccttaagccgtccgaacgtgatccaagctcgacgctgttgatcgcgcaactgttgcaggaggccggcttgcctaaaggtgtactgagtgtggtgcacggcgacaagggtgcggtggatgcattgatcgaagcgccggaagtaaaagccttgagctttgtaggctcgacgccgattgccgagtacatctattccgaagcgaccaagcgtggcaagcgcgtacaagcgttgggcggggcgaagaatcacgctgtgctgatgccggatgcagatctggataatgccgtgagtgccttgatgggggcggcgtatggttcttgcggtgagcgttgcatggcgatttcggtggcggtatgcgtgggtaatcaggtggcggacgcgttgatcgccaagttagtgccgcaggtcaaggcgttgaaaattggtgcgggcacctcttgcggtctggatatggggccattggtgacgggccaggcgcgggataaggtcagtggctacatagaagaaggtgtggctgcgggtgcggagttggtggttgatggtcgcggtttgagcatcgctgggcatgagcaagggttctttctcggcggcagcctgttcgaccgcgtgacccctgagatgcgcatctataaagaagaaatcttcggaccggtgctgtgtgtggtgcgagtcgacagcctcgaagctgcaatgcaactgatcaatgatcacgaatatggcaatggcacctgcatcttcactcgtgatggtgaggcggcgcggctgttctgtgacgagattgaagtgggcatggtgggagtcaatgtgccgctgccagttccggttgcctatcacagctttggtggttggaagcgctcgctgtttggcgatctgcatgcctatgggccggacggggtgcgtttctacacccgtcgcaaggcgatcacccagcgctggccgcagcgggctagccatgaagcgtcgcaattcgccttccctagtctttaaagcttggtaagtggaaagccggctccttagagccggctttcgcgttttcggagcttttttgatcgatatgacagaaatgtgaaaaagaaggttgacgacagattccatacgcctataattcgccccacttccggcgcagtaaaaatggaaaactccttggtaaacaatgagttatgaagttttcggcagcaagttgcttcagttcatcgaagccaaaaggaagttgaaaaagaggtgttgacagcagcgtgtaacgctgtagaattcgcctcccgctaacgagagatcgaaagcgcaagtggttgaagttgttgaagaaatcttcgaaaacttctgaaaataaccacttgacagcaaatgaggctgctgtagaatgcgcgcctcggttgagacgaaagatcttaaccaaccgctctttaacaactgaatcaagcaattcgtgtgggtgcttgtggagtcagactgatagtcaacaagattatcagcatcacaagttactccgcgagaaatcaaagatgtaaccaacgattgctgagccaagtttagggtttcttaaaaacccaaagatgtttgaactgaagagtttgatcatggctcagattgaacgctggcggcaggcctaacacatgcaagtcgagcggtagagagaagcttgcttctcttgagagcggcggacgggtgagtaatgcctaggaatctgcctggtagtgggggataacgttcggaaacggacgctaataccgcatacgtcctacgggagaaagcaggggaccttcgggccttgcgctatcagatgagcctaggtcggattagctagttggtggggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaaggattgtagattaatactctgcaattttgacgttaccgacagaataagcaccggctaactctgtgccagcagccgcggtaatacagagggtgcaagcgttaatcggaattactgggcgtaaagcgcgcgtaggtggtttgttaagttggatgtgaaatccccgggctcaacctgggaactgcattcaaaactgactgactagagtatggtagagggtggtggaatttcctgtgtagcggtgaaatgcgtagatataggaaggaacaccagtggcgaaggcgaccacctggactaatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttctagagatagattggtgccttcgggaacattgagacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccagaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaatcgacgacatcagctgctccataagttcccacacgaattgcttgattcattgaagaagacgataaagaagcagcccgaaattgggtctgtagctcagttggttagagcgcacccctgataagggtgaggtcggcagttcgaatctgcccagacccaccaattttgtgtgggaaacgcctgtagaaatacggggccatagctcagctgggagagcgcctgccttgcacgcaggaggtcaacggttcgatcccgtttggctccaccactactgcttctgtttgtataaagcttagaaatgagcattccatcgttgtgatggtgaatgttgatttctagtctttgattagatcgttctttaaaaatttgggtatgtgatagaaagatagactgaacgttactttcactggtaacggatcaggctaaggtaaaatttgtgagttctcttaactgagaaattcgaattttcggcgaatgtcgtcttcacagtataaccagattgcttggggttatatggtcaagtgaagaagcgcatacggtggatgccttggcagtcagaggcgatgaaagacgtggtagcctgcgaaaagcttcggggagtcggcaaacagactttgatccggagatgtctgaatgggggaacccagccatcataagatggttatcttgtactgaatacataggtgcaagaggcgaaccaggggaactgaaacatctaagtaccctgaggaaaagaaatcaaccgagattcccttagtagtggcgagcgaacggggactagcccttaagtggctttgagattagcggaacgctctggaaagtgcggccatagtgggtgatagccctgtacgcgaaaatctcttagtcatgaaatcgagtaggacggagcacgagaaactttgtctgaatatggggggaccatcctccaaggctaaatactactgactgaccgatagtgaactagtaccgtgagggaaaggcgaaaagaaccccggagaggggagtgaaatagatcctgaaaccgtatgcgtacaagcagtgggagcccactttgttgggtgactgcgtaccttttgtataatgggtcagcgacttattttcagtggcgagcttaaccgaataggggaggcgtagcgaaagcgagtcttaatagggcgtctagtcgctgggaatagacccgaaaccgggcgatctatccatgggcaggttgaaggttgggtaacactaactggaggaccgaaccgactaccgttgaaaagttagcggatgacctgtggatcggagtgaaaggctaatcaagctcggagatagctggttctcctcgaaagctatttaggtagcgcctcatgtatcactgtagggggtagagcactgtttcggctagggggtcatcccgacttaccaaaccgatgcaaactccgaatacctacaagtgccgagcatgggagacacacggcgggtgctaacgtccgtcgtgaaaagggaaacaacccagaccgtcagctaaggtcccaaagttatggttaagtgggaaacgatgtgggaaggcttagacagctaggaggttggcttagaagcagccaccctttaaagaaagcgtaatagctcactagtcgagtcggcctgcgcggaagatgtaacggggctcaaaccatacaccgaagctacgggtatcacgtaagtgatgcggtagaggagcgttctgtaagcctgtgaaggtgagttgagaagcttgctggaggtatcagaagtgcgaatgctgacatgagtaacgacaatgggtgtgaaaaacacccacgccgaaagaccaaggtttcctgcgcaacgttaatcgacgcagggttagtcggtccctaaggcgaggctgaaaagcgtagtcgatggaaaacaggttaatattcctgtacttctggttattgcgatggagggacggagaaggctaggccagcttggcgttggttgtccaagtttaaggtggtaggctgagatcttaggtaaatccgggatcttaaggccgagagctgatgacgagtcatcttttagatgacgaagtggttgatgccatgcttccaagaaaagcttctaagcttcaggtaaccaggaaccgtaccccaaaccgacacaggtggttgggtagagaataccaaggcgcttgagagaactcgggtgaaggaactaggcaaaatggcaccgtaacttcgggagaaggtgcgccggtgagggtgaaggacttgctccgtaagctcatgccggtcgaagataccaggccgctgcgactgtttattaaaaacacagcactctgcaaacacgaaagtggacgtatagggtgtgacgcctgcccggtgccggaaggttaattgatggggttagctaacgcgaagctcttgatcgaagccccggtaaacggcggccgtaactataacggtcctaaggtagcgaaattccttgtcgggtaagttccgacctgcacgaatggcgtaacgatggcggcgctgtctccacccgagactcagtgaaattgaaatcgctgtgaagatgcagtgtatccgcggctagacggaaagaccccgtgaacctttactatagctttgcactggactttgaatttgcttgtgtaggataggtgggaggctttgaagcgtggacgccagtctgcgtggagccaaccttgaaataccaccctggcaactttgaggttctaactcaggtccgttatccggatcgaggacagtgtatggtgggtagtttgactggggcggtctcctcctaaagagtaacggaggagtacgaaggtgcgctcagaccggtcggaaatcggtcgtagagtataaaggcaaaagcgcgcttgactgcgagacagacacgtcgagcaggtacgaaagtaggtcttagtgatccggtggttctgtatggaagggccatcgctcaacggataaaaggtactccggggataacaggctgataccgcccaagagttcatatcgacggcggtgtttggcacctcgatgtcggctcatcacatcctggggctgaagccggtcccaagggtatggctgttcgccatttaaagtggtacgcgagctgggtttagaacgtcgtgagacagttcggtccctatctgccgtggacgtttgagatttgagaggggctgctcctagtacgagaggaccggagtggacgaacctctggtgttccggttgtcacgccagtggcattgccgggtagctatgttcggaatagataaccgctgaaagcatctaagcgggaaactagcctcaagatgagatctcactgggaccttgagtcccctgaagggccgtcgaagactacgacgttgataggttgggtgtgtaagcgctgtgaggcgttgagctaaccaatactaattgcccgtgaggcttgaccatataacacccaagcaatttgtttctctaacgagcatcagattgcggtgtgtgaagacgaaatgaaccgaaagttcgacgctcacaaagcaccgaccgctgtcacatacccaatttgctgaagcgaggcctgctggccacgactcagtacccgaatttcttgacgaccatagagcattggaaccacctgatcccatcccgaactcagtagtgaaacgatgcatcgccgatggtagtgtggggtttccccatgtgagagtaggtcatcgtcaagattaaattccgaaaccccaattgcgaaagcagttggggttttgttttgggcgctcggaaagtgtccacgatgtccccgtacgcctgtcactctctcccacccagcccgacaaaattgcacagttatttctgaaccagaccactagaatagccacctaaccatttttagagtcagagccctatctatgcccgatccggttgatgccattgaggcgtcagacttaccactggacgacctggtggcatgccatgagtgcgacttgctgatgcgcaagccaatgctcgcccgcggcgaaaaagcccaatgcccgcgttgtggttacgagctgtacgctcatcgccacaatgtcgtcgaacgaagcctggccttggtgctcgcagccctactgctgtacgtccctgcgaactttctgcccatcatgcagctcaatctactcggacagacctcgcaggacactgtatggagcggcgttgtcggcctgtttgattccggcatgcaaggcgttgccgtagtggtgttcctgtgcagcatgggcattcctttgctcaagctgctctgccaattagccgtgctgctcagcattcgctggaagatcggccgcagttatgggctgctgctgtaccgcatctaccaccacatgaaggattgggggatgttggaggtctacttgatgggcgtgctggtggcaatcgtaaaacttgccgacatggcttccattacggtcggcctgggcctggcctgtttcatcagtctattaatggttcaagtactgctggaggtggtgatgtcgccccaccaggtctggcgagcactctcaggagaggatgaacatgcgggcgattgatgcaggcattctggtgtgtaccgaatgccatgaattgaacaagcaggaagcggatgccgacgagcagctctgcacccgttgcggtgcgttgatccatgctcggcgtcccaacagccttacacgcacttgggcattactggtgaccgcggcgattctgtatatccccgccaacctgttaccaatcatgaccgtgaactccctcggccaaggcgatcccagtaccatcatggccggtgtgatccagctggtgcagcacgggatgtttcccatcgccgctgtggtattcatcgccagtatcctggtgccgacgttcaagttggtaggcatcggcctgctgctgttctcggtgcagcgtcaccaaccactgtccgcgcaacaacgcattgtgatgtaccgctttatcgaattcattggccgctggtccatgctggatatcttcgtgatcgccatcctggtggcggtcgttaactttgggcgacttgccagtgtcgaggccaatctcggtgctgcagcattcgccagtgtggtgatcttgacgatgcttgccgcagtaactttcgatccccgactgatttgggataacacggagtcggacgacgaccatgagtgaattgcctaaagctaaaacccgcccagcctccaattggtcggccatttgggtgttgcccctgattgccctgatcatcggtggctggctgggatggcgtgcctattcccagcaaggcatcgagatccaggttcgcttcgagagcggcgaaggtatccaggtcaacaagaccgaagtggtctacaaaggcatgaccgtaggcaaggtcaaagccttggccctggatgacgagggcagcaatcgcggggtgattgctaccattgagatgaataaggatgtcgagcaatacctcaagaccaacacccgcttctggttggtcaagcccagcgtcagcctggccggcattactggcctggagaccctggtctcgggtaactacatcgccgccagcccaggcgatggcgagcccacgcgcaaattcaaggcactctccgaagaaccgccgttatccgatgccaagcccggcttgcacctgaccctcaaggccgaccgcctgggctcgctgaaccgcggcagcccggtgttctacaagcagatccaggtcggccaggtcaaaagctacctgctgtctgaagaccagagcaccgtcgaaatcaaggtctacattgagccaacctacgccaatttggtgcgcaaacacacgcgcttctggaacgccagcggcatcagcatcgacgccaatctctcgggggtgaaagtgcgcagcgaatctctctccagcattgtcgccggcggtatcgccttcgccacgccggagaatcgcaaagacagcccgcccaccgacccgagcttgccgttccgcctatacgaagatttcgatgccgccgcagcgggcatcaaggtcaaggtcaagctcaccgacttcgaaggcctccaggccggacgcaccccggtcatgtacaaaggtattcaggtcggtagcctgaaaaccctgaagattgatccggacctgtccagcgccagcgccgagttgaccctcgatccattggccgaagattacttggttcaggatacgcaattctgggtggtcaagccgtccatctccctggctggtatcactggcctggaggcactggtcaaaggcaactacatcgccatccgtccgggtgacaaaggtacgccgccccagcgggaatacgtggctcgtgccaaggcgccgccgttggacctgcgctccccaggtctgcatatggtgttgctcaccgacagcctgggctcgctggatgtcggcagcccgatcctgtacaagcaggtcaaggtcggctcggtgcagagctatcagttttcacgcaagaagaagcagctggtgatcggtgttcatatcgagaaagaatatgaaagcctggtcaacggctccacgcgtttctggaatgccagcggcgttaccctcagcggcgggcttaccggcggcattcaggtcaagagtgaatccctggccagcctgatggcgggtggtatcgccttcgaaacgccggaaccgaatgtgccgctcaaacgccgcatcccgcgcttccgtctgtttgctgaccgtgaggccgccaaccagcacgggaccctggtgaccatcaaggtcgaccgcgccgacggcctgagtccaggcacaccggtacgcttcaagggcctggatgtgggcaagatcgagagcgtcgatctcagtgccgacatgcaatcggtgctgctcaaagcgcgtatcacccaagtggcggatcgcatcgctcgttctggcagccagttctgggtggtcaaacctgaactggggctgatgaagacggccaacctggaaaccctggtcaccggccaatacatcgaggtgcaaccggcgatgaaaaatgccggcccgcagaagagttttgtcgccctggcccagccacccgaagccgtgcatcaggaagcgggcctgagcctgacactcagcgccgctcgccgtggttcgttgaaggaaggcgtgccggtcacctaccgtgaagtcaccgtgggcaaagttaccggctatgagttgggccaaaccgccgaccgtgtgctggtgcacatcctgatcgaacccaaatacgcgccactagtacgcagtggcagccgcttctggaacaccagtggcttcgggctcgacttcggcctgttcaaaggtgcgacggtgcgcaccgagtccctggagacgttggtggccggcgggatcgcctttgccacgcctgatggcgagcgcatgggcaaccccgcacggcagcagcagacgttcccattgttcgacaagtttgaagatgagtggctgacctgggcgcctaagatcccgctgggcaaatagaccgaggcgcggccatcgggggcaagccccctcccacactttgatttgtgaacacggtcaaaatgtgggagggggcttgcccccgatgaggccctcaaaatcactgcaaagacaaaaaaaggccacgatccataagatcgtggcctttttgcatttcagcgcaacacgtcagacctcatccagctccggctcgtccgcctgcacattcactgtcgccttcaccacatcatgacgacggatgtacttccagtccgcctcatcgatgtagattccgttcggcccgctgccgccttcgaggtcgatcgccacctgggcggacacctgcggcttcacactcgccaggatcggcacgaagcccagttgcaggctggtttccagcagtgccgcctggttcttctcatcgatgtccgccgcttcgtcgaggtagtaaggcaagcgcacacgaccggcctggtcgcggtccatcaggtgcaacaacaagtacatgttggtcagcgccttgatggtcatggtggtgccgttggacgccgcgccgtcgatgtcggtatggatcaccggttggccgtgtaccttggtgatctcgaacgccagttcgaacaggtccttgaggcccagttggttatggttggcagccaccaggcgtgccaggtattccttggcctcttcgttcttgttgtcctgctcggcgctctggctgaggtcgaacactgacagcgtctcgccttcttcatactggccggcactgtggatgatctggtcgatatgcttgagggcttccttgttcggcgccagcacgatgcggaagctttgcaggttggaaacctggcgcttgttgatctcgcggttgaacagcgccagctggtgttcaaggctgtcgtaatcgctgcggatgttgcgcagggtccgggcaatgtcggtgaccgccgcacggcgtgccttgccgagggtcagcgcttcatcggtacggtgcgcatacgcgttgatcagcagttgcaggcgacgttcgacatcatcctcactgtcgaacttggccacacctttgagacgcacttgtgcgtacagcgcttcgatctggccatcggcgcgcagcaagccctgccagctgtcctgatagtcattaagcagcggcagcaggttgtccatggaatcgtcgaccgggtccatgaacggtgtgccaaacggcaggtctgtcggcaacagctgacgacgacgcagcgcgtcatccagcgtacgttgcttggcttccatgtcgccgatctggcggccgaccaattgcagcttggccgacagttgctgcacgcgctcggtaaacgcatcgctggagcgtttcaactcgtcctgggcggcttccatctgcgccagttgttcgagcttctcgccttcctcggcactcagggtctgggtgcggcggaagtcttccagcgccttctgcgcatccagcacctgctggtacagcgcttcggtctgggtcttgctcgcggcgcggtcggaagccacggcctgctgggttttcagttgcttgagttctttttccaggcgttctttctggtcacgcaacgcggcgcgatccgccagggcctgcaaggccggaggctcgatgtgcgagatgtcgatggacagccccggcacttcaaagcgctcgcccttgaagccatcgaggatctgttccagggatttgacccactggccgtcctcgtccagcgtgatgccatgctcacccagcggcaggctgaacaacgaactgttgaacaggcgcatcaggcgctcgacatcctgctgcgaaaactcttcgcgcagtttggcgtagctgttgttgtcggcgtgatcgagctgctgcttgacggacttcaagcgtttttccaggtcgcgcagacgctcgtccagatcctcggcgctgaactgccgcgactgcgccaaggcgcccgccagttcatcatgggcatccttggcggcgagcaattgctgctccagcaccttgacgtcattcaccaacgcgaagcgatgcttgagcaccgacaattcgcccaaccagcgctggatgccactgatttcccgctccaggcgcatcagctcctgggtgccgccgcgctggtcgttctgcagcgcgtcctgctcgttgcggtagtgttcagcctggatggtcagctcttccttgcgcgcactggcatagtccgaccaggtacccagcaatgaatccagcagcggcgacaggcgatgcagtttgccgcgcaaggcgtcgcgttgtttcacgccattggccagcgcctcgaccaagggaccggccgccaccagcgagttgtagtcctgctccatgcgtcgcacatcgcggaaggcctcttcgcacgcggcgatgtagtcgacactgccggagcgcaggctatgttcgaacgcatcgaggaacagttgcttgagcttggccgccgtgatttcgcgcatgtgcagcaggttgataaacagcgcacggaaggtcttcaggctctgttcgctggtggagcgcagcgggatcagggtcaggtccagcgggatcgacgtatggccgcccaccagcaagcgccgcagttcatcaggcttgagttcgtaggctttgagcccttcgcgttcaaggttggtgaacagttctttctgacgcaggcaggtgtcgtttttctggtaatgggccaggtccagcttgccggcataggcaaagaactggtgaccgaaaccgccgcctggcccacgcccgaccacgccgataacgtgcgggccgtggggcagggagacttccaccaggatgtagctggtgtcggtagcaaagtagaagcgccgtgattgctccagggtgtatttgccgaaactcatgtccgacatgcgcgccaggatcgggaactgcaaggcgttgatcgaggcggatttacccaggttgttcgcgccatataccgacagcggctcttccagcgggaacaggcccaggctgtagccggcggtgttcaatagggcgaagcggcggatgccgtagcgttccttactcatgcgtcggtctcctgttcttcggcaatggcacgggccagggcgtcttcttcgctttcctcattgaaggcgctcaggtccagcgggtcatcggtctccagcagtttgtcatcgctgtcttcgtcgatgatcaccggcgccggcagcggcagtacgctgtgcacgctggcggcaaggtcgcggtcctgctgcacggagaggcacacgtcgaggaaacggtgcatcggcggcaggaagcggtaaatgccattgtcctcgctggcaaaacccagttgggtcatgcggcgcatgattttttcttcgagctcttcctgggtctgcacttcggcctggataaacaggtcgcggtatttctccagcagcgaaggcagttcgtcgcggcccaggctgccgccgtcgagcaccgcaatcgggtcgcgaccctggtcggccagatgctcgacgaggatgaaggtaaacaaggccaggcgctgggcagtcttgttgacttgcgcgctggcaatggcggagtccggcacgaagtaatagaaaccgcgggtatcgcacaccagctcaaagcccagggccttgaacagcgtgcggtattggtcctggaagtttgacagttgcgcgtacagctccgggtcacgacggctgacgtggtaacccttgaacagctcgcgaaagatcggcgccagctgggacagttcggatagatcaagatgcataaggcgtgctcgcagaattctcggtggcgtcgctgccggccgggagcagggcgaaggagcgcaggctgacctggtgctcgtgggtgtggtaatcgcggcgttccaggcgttcgcgcttgaagcgtttctcccgggacaggcgcgaaaaccagtacagcaattcgtcggtagcgccgtccggttcctgttccagcagccaggtcatcaggtccggcatcggcagtgcttcttcgcagcgctcgagcatttccttgaccgtacgcggcgcgcgctgggcttcgcccttgtgggatttatgcgccttggggaaacgcgccggtttcggctcgaaattcgccagggcatacacataagcttcgacctggctggcgctgcccaggaaggtgctttgtggccgggtaaacatcggcattgcagcctgtggcaccgcgtccaggcccttgcggcggatcgccgacagggccagcgccgcgccacgagtcacggcgttgtgtcggcgcgcttcttcgcgcagcggcaacagcagctcccgcgcatggcgcaaggtcagctgggcgctggtctgcatttcgaggatgcgcgcgtgggtacgcagcagcatgtcgtcgtccaccagatggccgagacgctgttgctcggtaagcatgcgcagcagcacgttctcgaccttgcgcacaccttgctcgaaggcgccgtcggcgttcaccagctggatcatcggctcgacgtattcgtcccaggtcgccaagacctcggcataacgctggcgcaacgggatctggcggtcgctggtcttggcgcggtcggccacggcggcgagggcctgttcgtcgttggcaagttttttcagcacgtcgcgcacgcgcatgtccagcaggcgcagttgccgcgccaggtcgtggccgtcgcggatgtcgaaggcgtcctggatataaccggccaggcgctcgaggtggcgcaggtaggcttcgatttccaggcacaggccaagccggtgttccttgcgaagataggcgaggaagtcgtggatctgcgcgttgagctcgaagcggttcgggctcttggccacaggcaccaggatatccaggcgaatccacacgtccagcaggctggtgatgtcctggggcgtgctgtccagttgttgggcggccaattgtgcgcgcagctcggcaaggctctgtgtgccttggtcgaagtgttcgcacagaggctcgagtaaggcccagtgttcggcgagggcgcgcaggacgcgcttgggttcgatcatgggaatggccggctggttggcgattaaaagtcgcgattgtactgcatcaggcgcgggaattatccacagccggtcagtgcacagtgggcgattgttaccgaacaacggtagaatccccgttctttacttatccacaagtggccgagctgtgcttatcgagtcccgacgtcgcgcttacttgaccgccatgcaggtggtcaactggctgccccgcaccgaactgccgtttgccgcgccgtcgcggcccaagttgttgcaggcgcttgagccctatgaggcgttcgagtcgtcgggggaagaggcggccgcgcccgtggcggtggtcaagcccccagtcgaaacacgtccggcggtcgaacgggcaaagatcgaagtgccacgccctgcgccggtgaccaaggctgccaaggtggtggaggaggccgcgccggtggtcaaggcgccggtagtgccaccgccccgctttgccctgcaattgctgcgggccgggcgttgcctgttgctggtggagctgcccaccggcgagcgtttccagtcacgcgacccggcctacctgctgctcaaggacatgctgcgcgccgccggcctgcccgacagcccccagatcatcggcgagcctgtacgctggccgcttttggtgcgcggcactatggaccagggccccgaagctgcacgggatttcgtccagggttttgtctcggcgcgcctggaagacgaaccctgcgtgtgcctgtggttgatcggcctgcccgccgtgcggtttgccggcgaagccaatgccgaggcctggtaccgcgagttgcaggtcgacagcctgggctcggtgtgggccctgccgggcctggaattattaatggaagagccacagcgtaaggctgatgtctggcaagccatgcgccggctgatggcgcgctggaaaacaactgatgagtgaggctttatccttccgcccgatgaccgaggccgacctcgacgccgtgctgaaaatcgaatatgcggcgttcagccacccctggacccgtgggatctttctcgacgggctgggcaagtatcaaatctggctgatgttcgaaggtgagcagcaagtgggccatggggtggtgcagatcattctcgatgaggcgcacttgctgaacatcaccgttaaaccggaaaaccaggggcgcggattgggtttggcgctgctggaacacctgatgtcccgtgcctatgccgccaatgcccgagagtgcttcctggaagtgcgggacagcaataccggcgcgtttcggttgtacgagcgctatggcttcaatgagatcggtcgccgccgggattattacccggctgtcggtggccgcgaagacgcggtcgtcatggcctgcaccctggtcgactgaacacacagaccaatgtgggagggggcttgctcccgatagcgatgggtcagtgacttattaagtgcctgacacaccgccatcgggagcaagccccctcccacatattaaaccgcggttttcagcggttaccgtctacagggtcaatatcggccagctcggcctcatccaggccattgccgccgccaatctcatcctcatccacaatgctgaggtcgaagtcggcagggttatcctcacctgcttcccgggcatcccgcgcgccatcctcgtggatcagcgtttccgggctcatatcgtcatcggtggattcatgatcatccgtcgaagccccggtcagcccggcttcgcgcacccgttcatcgggcattaaaagatcgcgctcacggcgtggcagctcgtcgccgatttccgctgtctggtcttcctggtcaaaatccagctcgcgcatttcacccatgcggtcttcgttatcatcaatgggttccggctgggttgcgccgtagggacgtcgtgattcagtcatggccaatcctcatactgtggggcttatagtgtgtggacaggcgtggctccctaaagattcaagctaattaacactcggcgtgacctggacgaggggttgtcagtcacaaaactgcgcatcattcctgaggctttccctgatgaacgaactacaagacctgcttgataacaacgaacgctgggcggatgcgatcaaacaggaagatcccgaattcttcgccaagctcgcccgccagcagaccccggagtacttgtggatcggctgttccgatgcccgtgtaccggccaacgagatcgtcggcatgttgcccggtgatctgttcgtgcaccgcaacgtcgccaacgtggtgctgcataccgacctcaattgcctgtcggtgatccagtacgcagtcgacgtgctcaaggtcaagcacatcctcgtcaccggccactatggctgtggcggcgtgcgtgcatcgatgcaggaccgccagttcggcctgatcgacggctggctgcgcactattcgcgatctctactatgagaatcgagacttgctcgctcagttgccgacggaagaagaacgtgtcgaccgcatgtgcgaactcaatgtgatccagcaggtggccaatgtcggtcacaccagcattgtgcaaaatgcctggcatcgtgggcagagcctttcgatccatggctgcatctatggcatcaaggatggccgctggaagagcttgaacaccaccatcagtggtttcgagcagctcccgccgcagtaccgcctgcgtccgctgggcgaagcctaagaccgcttgtgttcgcgccaccaggtcatgaaagcctggccttcggcgttcagcggttccttgctgcctgtgatccaaccccggcagttcagctcgccgcaatggcaagcgaactgccgggccagtgcgtcttcggtcatggcgtaatcaagggtcagcaggctaccggcgaggatgggttgcaccgtccatagctccaggtacgtggtgtccaggaacacgttcgggttgcaggagtgctgcaacaggccgcagaaccaacaatcgtacaaatggatacgcggcgatagctgcagcgtatgcgtgcgtcggtcgctgacggcgtatcctgaaatctgggcaatgcgcacgcggctgtcaaaggcaatgcgcgccatgacaccgcccgtcatcccgtgggtgcctcgcttgatctggaagtgctcggtcgaggggtaaccttgctccacgagcagcgtcttgaagggatacaggcagctactcaccgcggttttagccttatccatggcttgagttttcattactctcctgaacggggctgcatggacctgcgggtattagctgactgccagtcttgcagcaaatgggcgcggcccaagattcgccgaagttggattcgatatctactgtcaatcttgacagtagagacgatttattcgcgttaaagcacaggcgccatgatggtgggcactggggcgacatttttcagctgtttcaactgcgctttgatagacggtgtagcgcacttggcattggcctgctccggcgtcaggtggcgcaccgaggtgtagaacaactcacaggtttgctccttgcgtgtgacttgccaggtgttcatgcacgccttgagtaacacgttcgcatcgctggcgggtttctggcccatgccggcctgccagcaggccgcgctcaaatcctggcccattactttcaacccggcgtcgtcggccttttgttcatcaccgtcatagcttgccgggtccgccgcataccagatgtagctggggtggttggcgcccagcacggatacgtttttgccggctgccgggctgatttgtgccagttccagcacgcccacattctggccgtattgttgcttgatccagctgcgcaccggcgcgccgaatgccaccatcggcagtgacccattggcgcgcaggctcagttccctgaccatgcgggtctggtactcggtgaagtagctgtagactttttccaggtctttacctgcattggacggcgcggcgatgggggcgatatcgatgatggtctggtaggccggcgtttcgctggccgggataccgttgtcggtgagcagcgccgcccagcggtcagtggtggccgattccagatagtcctgggcctgggtgagtgagtaatccggtgggaagtgcagcagttcgatgctcttgcggttctccagggccatgcccagcggcaggaacagataccagttataagcccacttgccgtcgccgttgagttggctggcgccttgataagccaggcccgcagtgttgagcaaggtggtcaaggattgaccgtaggtatccggtacgccgctgaaggtcgccgcgatctggccgtcgtgggttttcacgctgaccttggcccggctgtaaccgtcacgctgcaggctctggctcaaatagtgctcggcggtctgttccagtgtccacggccgaaagcagatcacattgcaattattagggaacgcaaacagctgggtgacacgttgcgtactgcccagtggcacctcgatgtcggcctgtacgaccgcactcgccagcagtgcggccagggtgaaggacagcctggtcggtttaaacatagttggttccttgtcagcgaggcccgtctgcgcgggataaaagcccacttgcacacagtagcggttgaccgggaaattcgcgtgttaaatcggcaggcatgtcgttattggataagcccctacaagttgaactgcaaggcgttggtcagatcacccatgggtttctggccgcgggcaatcatcgcatcatcacgctgcttgagcccatccagggtctccaattggaacacccgggtgatcaagcgcaggatggatgccgtgtcatacaccgtatggtccaccgtgcctttgcgcgcaaacggcgacaccaccagggccggcacgcgcgtgcccgggccccagcggtcacccttgggcggcgccacatggtcccaccagccaccgttttcatcgacggtgaccaccactaccatgtttttccactgcgggctttcttgcagcaccttcaaggcgcgggcgatatggcggtcgccggaggcgatatcggcataaccggcgtgcatgttcaggttgccctggggtttgtagaagctcacggcaggcagtttgccggcctgggcatcggcgaagaacttgttggtagtcgactcatcgcccaagccaccgtcgcgcaggcgcttgtcacgttcagcgcgattttgcgggccttgctgcttgaagtagttgaacggttggtggtggtactgaaagttcggaatcttggggataccaccggaatccttgaattgctccaaagtggcttgccacgcgccggcgtaccaggcccagtcgacgttgcttttcgacagcttgtcgccaatgtgctcgtgggtttgcggcaccagtacgttgggcaggtctggtttggaatagtccggattttccgggtcgcgaatccaagtgggccaatacggtggggccagggtgttcaccccgtagccatccggcgtcagtgcgctagggccgaactgtggcgggcccgtcatcgcgctggccggggacttgtccagaggcttgagtcgcgtgtcggtggggtcatcgctttgcagcgtggcgatctgcgccttggccaccgactgcgcggcatcaggatagaacggtgccgtggcgctgatcaggtattggtgattgaggaacgagccaccaaacgcgccctggaagaagttatcgcagagtacaaactccttggccacgtcccacaggcgcagggaataacggctctgggcataatggcccatgaccaggccaccggaatcgccccaggcgacaaaaccgtcgtttttgccgccgttgatctgcatctggttctggtagaacacatgccacaagtcgcgggttaccaggctcaatggcaggtcctcggcgttaggacccttgagagcgaacggcgcgttgggcaggttttgctggaattgcacttcgcttggataggacacgccgtccacggtttgcgggccgacttgcaacacaccgccccacgtggggggcagggtggtcagtacactgccatcgcggtcgcgctgctggaagtccgtggcggataacgctgaaagcggtttctccaatcctgggaaatcggcaaacaggttgttgaagctacggttctcggcatagatcaccaccacggtcttcacctggtcgtgcaacgccttgtccagctcttgaggcgtaagtggtcgcggtaccggcgtactgggtgcttcgctggtattgccgcaggcactcaaggttgcaccgacccccaacaccgccgcaccgccaaggaagcgccggcggctggtgtctaccggtgcttgggtggtggagtcgggggaggggcggtcttcgtgctcgtcactcattgcgggggagtccttggcgagatgttgcaagatatttcgcaggacggtagcaacggaatgtgacggaacgaagacaggcttgagagcgctacagaacaaactgtgggagcgggcttgctcgcgaatgcggtggatcagttaatgagtccgttgactgacactgcgcattcgcgagcaagcccgctcccacaccgaccgcgctagggcatgaccggcggcaaatatttcaacgtcgtccctagcgcccacagtaaaaacagcaccaacggtgtgtgcaccagcaactgcacaaacgaaaacccgatcaaatcccgtgccttcaaccccaatacccccaagagcggcagcatatagaacgggttgatcaagttaggcagtgcctcggccgcgttgtagatctgcaccgcccagcccaggtggtattgcaggtcattggccacctgcatcacataaggcgcttcgatgatccacttgccgccgcctgatgggatgaagaaacccagcaccgccgaatacacgcccatcagcagcgcgtaggtgtcatgggaggcgatggaggtgaagaacgtcgagatatggtgtgccaaggtctggccgtcgccgcccttgaccacggtcatcaacgcggcaatcgagccgtacagcgggaactggatcaacacgccggtggtggtcggcaccgcacgggccacggcatccaggaagctgcgcgggcgccagtgcagcagggcgccgaccatgatgaacaggaagttataagtgttgagccccgaaatggcgctgatcgccggcttggtggaaaactcatgaaacagccagccggccgccagcaaggcaagcagaatcgtcagcaacgggctgtgttccagccattcgcccgggcgcgtcggtgcctgtggcttgggcaggttaaaggccgggtcgacaccgcaggccttggcgtcacgggcgctgttggggcctggcgcggtggcgtaggcgatgaccagcgacaccacgatcagcgccagcaacagcacgccggattgccacaggaagatggtttcggtgaacgggatcatcccggtgatcgacaggatcgacggcggcaagctcgccgggttggcctgtaattgcgctgccgacgacgacagccccagcgcccacacggcacccaggcccaaatacgctgcagcgccggcggcgcggtagtccatgcgcaaatccgtacgccgggccaacgcccgcaccagcaaaccgccgaacaccagggacagcccccagttgagcagggaggccaccatggaaatcaacgccacccaggccaccgccgagcggccgttcctggggatgcgcgccaggcggtcgatcaacttcatcgccgggggggaactggcgaccacataaccgccgatcaccacaaaggccatctgcatggtgaacgggatcaggctccagaacccgtcgccgaaggccttggccgcttcggccggtgcggcgcccatgcccagggtcgccacggtgacgatgatcacggcgagggcggcaaacacccaggagtcaggaaaccaacgctctgcaaagttggagcagcgcagggcaaatcgggcatagcggctgtcttcgatagcatcggccacgagtctttcctcttgtagttattatgggttttggcagttttacggcatgttcctctacacccattgatttgggaatgtagttatcttcaacgatcgatgagtaaaacaaatatatccatcgtgattgccatcaatgggctcagctcataacctgcacgccattttgtttgcctgccgagcctgcacatgactgccaccatttccccacgggcgcagcgtttttcccgctccgactataaaaccctgggcctggccgccctcggtggagccctggaaatctatgacttcattatcttcgtgttcttcgcgctgactctcagccaactgttcttcccccctgaaatgcccgagtggctgcgcctgttgcagagcttcggcatcttcgtcaccggctacctcgcccgcccgctgggcggcattctgatggcgcactttgccgaccacctgggacgcaagcgcgtattcagcttgagtatcctgatgatggccttgccctgcctgctgatcggcatcatgccaacctacgcgcaaatcggctatttcgccccgctgatcctgctggcgttgcgcgtactgcaaggtgcagcggtgggtggtgaagtgcccagcgcctggactttcgttgccgagcacgcaccgcgtcaccaccgcggctacgccctgggctttttgcaagccggcctgaccttcggctacctgctcggcgcattgaccgccaccttgctggcacaagtcttcacccctgcagaaatcctcgactacgcctggcgcttgcctttcctgctcggcggcgtattcggtgtgatcggcgtatggctgcgccgctggctcagcgagaccccggtattcctggaaatgcaggcacgccgccaagcggccgccgaaatgccactgcgcagcgtgctacgcgatcaccgtgccgtattgctgccggcgatgatcctcacctgcgtgctcacctcggccgtggtggtgctcgtcgtcatcaccccgaccatgatgcagaaaaccttcggcatgagccccagccataccttcgccttaagtgcgctgggcatcgtcttcctgaatatcggttgcgtcctcgccggcctgctggtcgaccgcatcggcgcctggcgcgcagtgctggtctacagcctgttgctgccggtggggatctttatcctgtatgccagcctgatcagcggtggcgtatggctgggcgcggcgtatgccgtggcaggcttgagctgtggcgtggttggcgcggtgccgtcggtgatggtcgggctgttcccggcgcaggtgcgggtgtcgggaatttcctttacttacaacatcgcctatgcgctgtgggcgagtaccacaccgttgctgttgatcgcactgatgccgaccagcccgtggatctgtgtggggtattgtgtggtgatgggggcggtgggggtggcgagtgtggcgttgtttggcaagcgccacactttggctgcgtgacgatcaagtcaggaagtgccagagcagcaacgtacccactaacccaaccaccgaaacgatcgtctgcaacaccgaccacacccagatcgtctgtttcaactgcaagccaaagtactcacgcaccatccagaacccggcatcgttgacgtggcagaaaaacaccgagccagcgccaatcgccagggcgaccagtgagctttgcgttgccgccaacccggccatcattggcgcgaggatgcccgctgtcgtggtggtggcgacagtggccgagccggtggcttggcgcagggccacggcgatcaaccaggcaagcaacaggtagggcatgtgtgcgccttcggcgaccttgctgatggtctggctgacaccggcgtccagcagggtttgcttgaggccgccaccggcgccgatagtcagcagcaacacggcgatgggggcgagggctttgcgcaatgtattgccgacgtcggcgcgtggcatgcctgcggcccagcccaggcatatcacggcggcgatgaccgccaaaccgagggcgatcagcggttcaccgaggaacttcaaggtcaggccgagggggctttctggcgccagcgcgactttggccagcgtgctgccgagcatcagtatcaccggcaacagaatgatcagcaacgacaccccaaagctcggctggcgcggagccttgggcggtgcgctgaacaacgcgccgatttcggccggctcatccacatgcaggcgcttggacagccagttgccgtagagcggcccggccaggatcactgccggcaccgccaggcaaaagcccagcaacatggtcaggcccaagtcggcgtgcaacgcgcccacggcaatcagcggccccggatgtggcggcatcagggcgtgcagggtggtcatgcccgccagcgccgggatggcgattttcagcagcggctggttcgaccgcttagccatcacaaagatgatcggcaccatcatcaccaggcccacttcaaagaacagcggcaggccaatcaccatggcgaccagcgccattacccacggcaatgacttgcccttgcccagcccgagcaaagtggtggcgatacggtcggccgcgccggattcggccatcagcgcgccgagcatcgcacccagggcaatgatgatcccggcttcaccgagaatcgctccagcacctttgctgaaggccttcgccacttcttccggtggcaggccggcgcccacgccggcgataaaggtgccaatcagaatcgacaggaagggcggcaatttggtcgcgctgatcagcacgatgatgctggcgatggccagcaggacgcagagcatgagacgggtgtcgtgaaccatccacgcggcagtcgataaacccaagacaggactccttatcgtgcaggttggctaatatgtttctttttgtttcagagcgaaaagcatacctgatagaacctgcccagggcgcccatgggcgattttggtgcgcccaaagctaacgacgcgctggcggatagatgacaattctgcaaaccatgccagtggatctggcctatagctctatgatccgctgcaccccaaccctcgaggacattccatgagcgcaggacacagccacgcccaagtacgcgccggccacgaacgcaagttatggatcgccctggggctgaccggcagcttcatgattgccgaagtcatcggcgcttttgtcaccggcagcctggcgctgttgtctgacgctgcgcacatgatgaccgacgccctggcgctggcgatttccctggtggcgatccaggtcgccaagcgcccggcggatcgcaagcgcactttcggctatgcgcggttcgagattctcgcggcggccttcaatgcactgctgctgttcgcggtggcgttctacatcttgtacgaggcttaccagcggctgcaggcgcccgccgcgatccagtccaccggcatgctggtcattgcagtgttggggctgatcgtcaacctgatctccatgcgcctgctcagcgcggccagcggcgagagcctcaacgtcaagggcgcttacctggaggtctggagcgacatgctcggctccatcggcgtgatcattgcggcagtggtgatcatgttcactggctggggttgggtcgattccgtggtcgcggccgccattggtttctgggtggtgccgcgcacctgggcactgctcaaggcgagcatgaacatactgctgcaaggtgtgccggagggtgtcgatatcgagcaggtggagcagggcatccgcagtgtgcccggggtcaaggacgtgcacgacctgcacatctgggccctcaccagcggtaagaacgtgctgagtacgcatttggtcgcggatgcctcccagggcagcgagcaagagatcctcagtcgagtgacggagttgctgcacgaacaattcgatattgcccacgccacgatccaggtcgaaggcgagggtttccagcatgacgaccacgacgaagtgcatgcctgagcctggctaacggatttgtaatcttccacccacggccctgataagtaccgaaagctacattgcccctcgctgggaaacctcagcgacttcatgggcgtggaactctcgttatggcaatttccgttagaacactgttaggggcggcggcgttgtggctaggcgcaaatgccgtccaggcacagaccctcaccctcgatgcagccttgcaaaccgccttcgccaacaacccggacctggcggccgcacagtgggaaatcgatatcgcccaaagcggccgccagcaggccggcttgattcccaacccggtggcctcctgggacgccgaagacacccgccgcaacagtcgcatcaccagcatcaaactcagccagaccctggagctgggcggcaagcgcggtgcgcgcatcgagctggccacccgcgcccaggatgccgccgcattgaccctggagcagcgccgtaacctgttgcgcgccgaggtcatcgacagctattacggcgccctgcgcgcccaggaacgcctcgacctggcgcaacgctcaatggccctggccgaacgcggtctggtggtcgccaacgggcgtgtcagcgctggcaaatcgtcaccggtggaggccacccgtgcccaggtgcagctgtcggaaattcgcctggagttgaatcgcgcccggattggcctgagtgacgcctaccggcgcctggccgccagcaccggcagtgctgccaccgacttcgaagcggtcgccacacaaaaaacctccgcaccggcgttacctgccaccgcacaattgttggcgcgccttgagcagaccgctgagctgcgcctggccgaactgaatattgtgcagaatgaagccagcgtgggcctggaaaaagcccagcgcattccggacctggatgtgtccatcggcagccaatacgacgccagcgtgcgcgagcgggtcaacctgttgggcgtgtcgatgccgatcccgttgttcaaccgcaaccagggcaacatcctcgctgccagccgccgcaccgaccaggcccgcgacctgcgcaacgccaccgagctgcgcctgcgcaccgagacccgccaggccctggacctgtggcaaacggcggataccgaggtgcgtgcattcaaccagcagatcctgcccgccgcacaaagcgcggtcgacagcgccacccgtggtttcgagatgggcaagttcaacttcctcgacgtgctcgacgcccagcgcaccttgatcgcggcccgcacccaatacctcaccgcgactgcccaggccaccgacgcctgggtacgcatcgaacgcatttacggcgacctcgcccggctttgaattttcctggagtctcctgatgaataaaaaacatggcatggcgttcgccgtcgccttgggcctgatgctgtccggtttcgcccacgccgacgaggaagaaggccatctcgaactcaccgagcagcagatccaagctgccggaattcaactggcccaggctcaaccgcgctcgatcagtaccgtgctgacgctgccgggcgaggtgcgcttcgacgaagaccgcacctcccacatcgtgccccgcgcggcgggtgtggtggaggcggtggaggtcaatcttggccagtcggtgaagaagggtgagctactggcggtgatcgccagccagcagatttccgaccagcgcagcgagttggcggcaagccagcgccgagtcgagctggcgcgcaccaccttccagcgtgagcgccaattgtggcaggacaaaatctccgccgagcaggattacctgttggcgcggcaaaccctgcaagaagctgaaatcgccctgaacaatgcccggcagaagatgaccgccctcagcggcagcgcggtcttggccggtggcaatcgctatgaactgcgtgcgccgttcgctgggatagtagtggaaaagcatctgggcgtgggcgaggtggtcagtgaaaccagcaacgcattcacgctctcggatttgtcccaggtgtgggtcaccttcggggtatttcccaaagacttgaacaaagtgcgcgtgggcaagccggtgaaagtcagctccacggaaatgggcaccgaagtgctcggcaccgtggcctatgtcggcaatttgctcggtgagcagacacgtaccgccaccgtccgcgtgacggtgcccaaccccgacgacgcctggcgcccaggcttgttcgtggccgtagagctcgccaccgacacctaccaggccaaggtcaccgtgccgcaagccgcgatccagaccgtcgaggacaaaccctcggtgttcgtacgcaccgcagatggttttatcacccgccatcttgaactgggcgtcagtcaaaacggctacgtcgaagtgcgccagggcctggaggccggcgcgcaggtggcgacggttggcagcttcatcctcaagtccgaactgggcaaaggctcggccgaacacgcccattgatctgcgagtgattccccatgtttgagcgccttattcaatttgccatcgagcagcgcatcatcgtgctgctggcggtgctgctgatggccggtgtcggcatcgccagctatcagaaactgcccatcgacgcggtgcctgatatcaccaacgtgcaagtgcagatcaactcggcagcggcggggttttcaccgctggaaaccgagcagcgcatcaccttccctatcgaaaccgccatggccggcctgcccggtctgcagcagacgcgttcgctgtcgcgttccggattgtcccaggtaacggtgattttcaaggacggcaccgacctgttctttgcccgccaactggtcaacgagcgcctgcaagtggcacgtcggcaattgcccgatggcattgataccgcgatggggccgatttccaccgggctcggggaaattttcctgtggaccgtggaggccgaggacggtgcgcgcaaggacgacggtacgccgtataccccgactgatctacgggtgatccaggactggatcatcaagccgcaactgcgcaacgtaccgggcgtggccgagatcaatacgatcggcggtttcgccaaggagtaccagattgcgccagaccccaagcgcctggccgcctacaacctgacgctcaatgacctggtcacggcgctggagcgcaacaacgccaacgtcggtgccggttatatcgagcgcagtggcgagcagttgctgattcgcgcaccggggcaagtggcgtccatcgacgacatcgccaacatcgtcatcaccacctcggatggcacgccgatccgcgtgcgtaatgtggctcaggtggatataggccgcgaactgcgcaccggcgcggccacggaaaatggccgcgaggtggtgctgggcacggtgttcatgttgatcggcgagaacagccgcagcgtgtcccaggcggtggcgaaaaaactcgaggagatcaaccgctcgctgcccgaaggggtggtggcggtcaccgtgtatgaccgcaccaacctggtagagaaagccatcgctacggtgaagaaaaaccttttcgaaggtgcgttgctggtggtcgcggtgttgttcctgttcctcggcaatatccgtgcggcgctgatcacagcgatggtgattccgctggcgatgctgttcacctttaccggcatgttcaccaacaaagtcagcgccaacctgatgagcctcggcgcattggacttcggcattatcgtcgacggcgcggtggtgatcgtcgagaacgccatccgccgtctggctcacgcgcagcagcgccatggccgtttgctgacccgcagtgagcgtctgcacgaagtgtttgccgccgccaaggaagcgcgacgggcgttgatcttcgggcagttgatcatcatggtggtgtacctgccgatctttgctctcacaggagtggccggcaagatgttccaccccatggccttcaccgtggtgattgccttgctcggcgcgatgattctgtcggtgaccttcgtaccggcggcgattgcgttgttcgtcaccggcaaggtcaaagaggaagaaaactgggtcatgcgcagcgcacgtcgggtgtacgacccggtgctcaattgggtgatgacgcgtcgcccgctggtgttcggcctggcgctgctgaccatcgtcgtgtcgggcctggtggccagccgcatgggcagcgaatttatccccagcctgagtgaaggcgactttgcccagcaggcgctgcgtgtacccggcaccagcctgacgcaatcggtgcagatgcagcagcaattggaaaaaaccttgctggctgaagtgccggaaatcgagcgggtatttgcgcgtaccggtaccgcggaaatcgcttccgacccgatgccaccgaatatttccgacagctacgtgatgctcaaacccaaggcccaatggcccgatccgaacaagtcccgcgaggcgatcattgccgatattcaacgggcaagcgcgattgtgcctggcagcgcgtacgagttgtcgcaaccgatccaactgcgcttcaacgaactgatttccggggtgcgcagcgatgtggcggtgaaggtgtttggtgacgacatggcggtactcaacagcaccgccggggaaatcgccgagaccttgcagaagctcaatggcgcctcggaagtgaaggtggaacagacctccggcctgccggtgctgaccatcaatatcgaccgcgacaaggccgcgcgctttggcctgaatgtgggtgatgtgcaggacaccatcgccgtcgccgtcggtgggcgccaggccggtacgttgtacgaaggggatcggcgcttcgacatggtcgtgcgtttgtccgacgcgctgcgcacggatatcgaaggcttgtcacggctgttgattccggtgccggcgctggccagcaacacgtctgggcaactgggctttatcgccttgtcccaggtcgccagcctcgacctggtgctgggtcccaaccagatcagccgcgagaacggcaaacgtctggtgatcgtcagcgccaacgtgcgcgggcgtgatatcggttcgtttgtcgaggaagctgaagccgccctcatcgcccaggtgaaagtgcccgccggttactggaccacctggggcgggcaattcgagcagttgaaagaagcctccgatcgcctgcgcatcgtggtgccggtggcgttgctgctggtgttcggcctgctgttcatgatgttcaacaacctcaaggatggattgctggtgttcaccgggattccgttcgcgctgaccggtgggatcatggcgctgtggctgcgggatattccgctgtcgatttcggcgggggtgggttttattgcgttgtcgggtgtggcggtactgaacggcctggtaatgatcgcctttatccgcaacctgcgcgaagaagggcgctcgttggcggtggcgatccacgaaggcgcgctgacccgcctgcgcccggtattgatgactgcattggtggcgtccctcgggttcatccccatggcactcgccaccggcaccggcgccgaagtgcaacgcccgttggcgacggtggtgattggcgggattatttcttcgaccttactgacgctgctggtgttgccggcgctttaccagtgggcccatcgccgcgaagaagaggctgcctaaaaccttgaacgcaccacaaagaccaatgtgggagggggcttgctcccgatagcggagtgtcagccagcacatgcattagctgatccgccgccatcgggagcaagccccctcccacactggacctgtgttgttttcagattcaggggaaacaccaggctaaaccgtgtgaaacgccccggctggctggtgacatgagcatgcccctggtgcaaatgcatgatcgacttgacgatcgccaaccccagcccgttgccaccctcggcgcgggtacggctgctgtcggcgcggtagaagcgttcgaacaggtgcggcaggtggtgcgcttcgataccacgccccgggttgcccaccgacagcgacacgccctggcagtaggtttccaccaacagcaacacggttgaggcctcaggtgtatggcgaatggcattggagagcaaattggatatggcccgctggatcatcagccgatcaccagtcaccagggcatcgccgcgcaggctcagggtgacctgcttgtcttcggcactcagggcaaacagctccatcacccgctgggcttcttgggccagggagacttcggtgaatgacgcccgcgctgccggatggctgacctgggccaggaacagcatgtcgctgacgatacgccccaggcgttcaagctcttcggtgctcgattccagcactgccttgtattcctcgggcgggcgctggcgcgacagggtcagttgggccttgcccatcaggttggtcagcggcgcgcgtagttcgtgggccaggtcatcggagaattgcgagagttgctgtacgcccgcatccaggcggtcgagcatcacattgatgccttgggccagttcacccagttcgtggggcaagttgtccacggacaaacgatgggtcaggtcctgggtggtaactttcgccgctacttggctgaactgcttcaacggtgccaggccgcgttgcaccagccaccaggcgcccatgccgatcaggatcaacagcagcggcagcgcaatcagtgtggcgcgcaggtaggcgctgagcaacgcctggtcgtccatgcggtccagggacagcagcacccgcacgcgttcgccgctggcaaggcgcatcaggctggaggcgctgagcacctggctgccatagttgtcggtccagttcaggtagccgagggtttcccggggcttgaagtcagtgagcaagggctcctggggcttggcaccgatgttgagtaacacgctgttattgggcgcggtgccgacgatggtcaggtagaaattgtcgtggccgatgaccaggtccaacagcgaatgggggcgggcacggatggcctgggcatcgagccccagggccaggctgtgctggatctgttccatcttgctttccaggttcttgcgcgccagtttttccaactcatgggtgagggccaggtaggccagggtggccagcagcaacaccagccccgcgcccatcaggctgacggtcaggcccaggcgcatcgacaggctgccggtcttcatggacgcgcttccaacacatagcccacgccacgaatggtgtggatcagcttgacctcgctctggtcatccaccttggcccgcaggcggctgatggagacttccaccacgttggtgtcgcagtcgaaattcatgtcccacaccagggaaataatctgtgtgcgggtcagcacttcaccgctctggcgcatcagtacgtggagcagggtgaactccttggtggtcaggtcgatacgccgagtgccgcgataagcgcgatggcggcgcgggtccagttcgaggtccgacacgcggaacacttccggctgtggaatgtgttcgctgcgccgcaacaaggtgcgcacccgggccagcagctcgggaaactcgaagggcttgaccaggtagtcgtcggcgcccatgtccaggcccttgatcttgtcagccagccggccccgggcggtcagcatcattactcgctgggtgctattgcgccgcagctcttgcagaacttgccagccgtccttgccgggcaggttgacgtcgagaatcaccagctcatacgcgtgctgcccggccaagtgcaggccatcgatgccattggcggcgcagtcgaccacatagccgctttcgttcaagccttgctgcaggtagtcggcggtcttttgctcgtcctcaaccacaaggatacgcatggggggttacctctaatgtctggggagagaaagcgcccatttccgtttggcagctgttttcaggggagtaggaaaagtctgaacgctgaagtaacttcagggtcaactgcgaccatcagtcgcataaccctgcgggcaaaaaaaacgccccaagcggggcgttaaaaactcatctctttccaaaggagctacacaaaagcttcagagatgaatgtgctcggtgaataagttgaagccagtatagaaatttcaacttaacgagaagctggagccaatattacaattttgatagacggctatttgtgaacagatgttagttaatcgcgagcaaatgtaagcttacagcgcgagcactgggtatatcgggtagccatttgctgcagctgctgtgcggcggcacgctgatgaaggttacgattctgcaaactggcggccttctaacaaataagtaatgttctggtgaacatgccgtcagggttcgctggttaatctcgacactgaacttttcagtcgaggaacccgtgatgaacttttataaagtggccttaggtgttttaaccgccgtcttatccttggctgcactggccgaaggcggaggggatcgaactttcgcccagatgatggagcgcaacgagaaagccatggccgcctacgcgctcaaaaacggcaagccagtgcctgaggtgcaggcctatcgctatggcatggagttggacattgccaaggtggtcaacgtgacgccgccggtccgctcgtgcaatgccgtgccctcgcgcatgacctatgaggactccagcggcaagctcaataccctggagtatcaggtgatgggtgtgtgccgaaacacgggcggttgaaggatcaaaaaatatagtggggcggtgggctaaagcgctattcagaaaatgccggcagcgccgatgcagcattaatcgtcccgcccatttgcccatcggtgccctatgttcaatacccgcctgaaacaggagctggccgctcttcgcgaagacttgtcgagcttgctgcaggtcaaggagagcctggagaacgaaatgctatgcctgacgctggatgccgagggccgggtggagtgggccaatgccaacttcctgcgagagctggtttattcgctgggtgaagttgtagggcgggcgattgaagacttggtgccggcccatgtgcgccaagacgagttccagttgcgcttcaagcatgcgctggcgcgcggcgaacattttgccggtgccgtacgcctgatgcggggcaatggcaaggaggcgtggctgcgctcgattgtgcagccggtgcgcaattcgcaggggcgtctcaagcatttttcaatgttctccagcgacctcacccgcaccatcgagaattcgcgtgaacatgacaacctgatcaccgcgctgatgcgctccacggcgttgatcgagtttgacctggacgggcacgtgctcaccgccaatgaccgcttcctcagcagcatgggttacagcctggcgcagatccagggtaaacatcaccgtatgttctgtgagccgcaggaatacaacagccccgagtaccagcagttctggaaacgcctgaatgccggcgagttcgtcgcggcacgcttcaagcgcgtggacagccatggccgcctggtgtggttggaagccacctacaacccggtgctggacgccaacgagcgactgtacaaagtggtcaagttcgccacggtgatcaccgatcaggtcaaccgcgagcaggcggtggccgacgccgccagcattgcctacagcacctccttgcaaactgatgatagcgcccaacgcggcaccaccgtggtgacccaggcggtggatgtgatgcgtgacctggcccagcacatgcaacaggccggcgaaggtattgaggcgctcaacgcccagtcccaagtgatcggcactatcgtcaagaccatcagcggcatcgccgaacagaccaacttgctggcgctgaacgcagccatcgaagcggcgcgtgccggtgaacaagggcgtggctttgcggtggtggctgatgaggtgcggcaactggcttcgcgcaccagcaaagccactgaagaaattgtcggcgtggtgcgccagaaccaggacatggcccgcgacgcggtcgccctgatggctgatggtcgcctgcaagccgaacaaggcctggccctggcggccgaggcgggcacggtgattgtggaaatccaggacggtgcgcaaaaagtggtgagtgcggttgggcagtttgccaatcagctgtcgagctgacgggctggctcatgagcatgttccagcgctgcactcggttttgaacccggcagagctcaatgtgggagggggcttgctcccgatgagggtatgtcagtcatacatctgtgactgacccaccgccatcgggggcaagccccctcccacattggttttgtagtgttttcaggtacgtggcatgcagtcgatagtgcggtttaccacggtcttggccatttccagcaagtgccacgcggcatggattcgggcacggtcgtggggttgcaggtgatcgcaacaatcccacacggtggctgaggcgctgtggatcaagtgggagatatagagttgggcgtcttcgaagctgagattttcgttaacggcgaggcagtccatgggtgggtcgggaagtgctttggtcatggtgtaactcctattgagcaagggagcgaccaccaacgctgctaaacgtaaggtggcagctgtacgcgggttagcagaccggtcaataggaaaaccagcgcacccggaggtgccccgcgcacagccaccataaacgcggatgtggaccatgtgcctattgagttcgggctgctaaacccgatcactgaactccagtgacggaccgaagactagccatcgattccaacaggcacaaggcggcggggattgtctcggaaacgtcctgcaatttaaagagacacggcttgctggccctttacaaaccatgaccaaatgccagcaacaccacccctcccacatttggatcagcggccgagcatctttacccagcgcgatggcggcatgccgtaggtgctgcgaaattgacgggtcatgtggctttggtcggtgaagccggcggtcattgctgcatccaccaagggttggccctgggccaacaagtggcgcaccaggtccagccggcgcatggtcaggtaacggtaggggctggtgccgaacaacaagcgaaaatcccgcgatagcgcccagcggtcgcggccggcatggtcggccatttcatccagggtgatgctgcggcccagggcgctgtggatgaattcccgagcacgctcggcggcgatgtagtcgaaggatttgcggctgacgatggcgccggacgccatgctcagcgcctgtgccaggtcgtacatggcgtcctgttcctgcatcgggtcaatcgagcactccaggttctgcagcaacacttcgctggcgcggtgcagccgcggatcggtggacaagccgccggggatgaacggcaacggtttgccgccgaggatctgctggatcagcgccggctccacataaatcatccggtacttgaagccttcatcgctgcccgcgcggccgtcatggagttcatccgggtgaatcaccatggtggtaccaggcaggctgtgggtcatgccgccgcggtaatgaaaactctgtacgccgaacaaggtgcgcccgatggcgtaggtgtcatggcgatgggggtcgaacgcgaagccggcaaagtacgcctcgatgcggtccaggccactggcgtgcggggcgcggtgcagccaatcgagggtgtgggtgggtttgcccatagtgacttgtcacaggaggaggttggaatacgttaaccgagtctgctgcggttgtctgcccggggtcttgtacgattgtgcaggcgtcggccgaggcctatgatcgcagttcgcctactgcactggtggagccttccatggattttttcaaccctgcctatgtgacgcccttggtggcgctcgcgctgctgtggacggtcgccgtggtgacgcccggccccaacttcttcaacacggcgcagttggccgccagctgttcgcgacgtcacggcgtggtggcatcggcgggcgtggcgaccggcacgattatctgggggctcgcgggtggcctgggcatcaagtcgctgtttactgccgcacccatgctgtacctggcgttcaagatcatcggcggctgctacctgatctaccttgggctgaaactgttcaagcgctcggcgccggcatcggtgcagttgcccgacgagccgcgacgctcattgttttccgcctggcgcttcggcttgctgggcaatctgtccaaccccaaggccgcgctgttcgtcgctacggcttttgcttcgaccatgccgccgtccccatcgcctgcgctgctgactctggcggtcatcaccatggcgaccttgtcgttcagttggtacaccagcgtcgccctggtgttttccagcgagcgcatggccagcctctacagccgttcgcgcaagtggctcgaccgctttgccggcagttgctacctgttgttcggtgcacatctggtagcgaatcgctgaccggccgtggtaagaagccttactttcaacagtgaggccgagtcatgagcaaggtgcgggtagggattatttttggtggtcgttcggccgagcatgaggtgtcgctgcaatcggcgcgcaacatcgtcgatgccctcgaccgttcgcgcttcgagcccatcctgatcgggatcgacaaggccggccactggcacctcaacgacacgtcgaacttcctgatcaaccaggaaaacccggcgctgatcgccctcaaccaatccaaccgtgaattggcggtggtgccgggcaaggccagccagcaagtggtggaaacctccggccaggggctgctggagcacattgatgtgatcttccccatcgtccacggcacccttggcgaagacggttgccttcaaggcttgctgcgcatggctgacttgccgtttgtcggctccgacgtgcttggctcggccgtgtgcatggacaaagacatcagtaaacgtttgctgcgtgacgccggtattgcggttacgccgttcattacccttacgcgtcgaaacgcggctcgcacctcttttgaggcggctgcgaacacgctcggcctaccgatgttcgtcaagcccgccaaccagggctcctcagtgggcgtgagcaaagtcggcaacgaagccgagtacttcgccgcggttgagctggcgctggggtttgatgagaaagtgctggtagagtctgccgtccagggccgtgaaatcgaatgcgccgtgctgggcaatgaacaaccgattgccagcggctgcggcgagatcgtggtaagcaacggcttctattcctacgacagcaaatacatcgacgaccaggccgcccaggtggtcgtgcctgcggctatcagccatgaagccagcgagcgcattcgcagcctggccattgaagcgtttgaagtgctgggttgcgcagggctggcgcgggtggatgtgttcctgaccgataatggcgaagtcttgatcaacgagatcaactcactgcccggttttacccgcatcagcatgtaccccaagctgtggcaggcggcgggcatgagctacagcgaactggtgagccggttgattgaactggcgctggagcggcatgcggggcgcaaggggttgaagatcagtcgctgatcataggcccgggtcagtaacgccatcaggcgttactgagaacttcgcgaaaaacgtccggccttatggccgcaatgtatagtagcgagcgcgctgcaccagaaggtgcccgacgcccttgttcccattcttgaagggtccttactgacacacccagaagctccgcaaatttttgttgcgacagccccgtcttgcttctcgcttcggcagcttgggtgacctcaacgtagtgcactgcaccgtaatttcccgctttgacatcctgaatggctgccagtaattcttcgccgatattgcgtttggcgtcacgtgccttcaattttttctcagtgagtggcatggttcatttcctttgcgattttgtacaggacatgtgccggaatactctcagtggtgcccttgccataaatcagaagtgctactactgctccgcactgcaattgagtggtgtagataattcgcaccgatccacttttgccccggccctccatgctccagcgtatctttcggcagccacctgaacgcggaataacgttccctgagtcaggatggctggcaaggaaagccatgaaaatacctttttcctcttcagtccaatagtcgggccatagtctgctgaataaaggcgattctatgatggtcaacacgcgaaattctacgtctttgacgtagcgtctggcaagaaagggcgggccagaaaatcgcaggtgagaaggcactgctcaagagggtttttatcgcaaaaaatgacagggcacttaagtttgggcgataggcaggggcctgagaggttggcttgtaggcgttttttatcggtatgtacgagcaatccacgaatagatcaacgtcctgctctccgccgggtgatgagtcctcctgcgatagctggcaaacgccggcgaggtgcagtaggtgcatacgtcactcacctcgatatgttcgcgcttaagcccggccgcgtgcagcaacagcagcccatacccgctcaaatcaaaccaggcacttcctgtttgcctggcatggggcggtgtaatgtgcggggcttgtagcggtgtcggttgctcaacgctccagggcccttggccgtgctgccacacgtggccttgatcggcctggaattcggcaataaacgccgcgctcacctcatagcagcacggtttgatcgacggcccaatcgctactcgcagttggtctgcggtaatgcctttatctatgaagcgctgcacggcattgtcgatgattccgcgctgcaagcccttccagccgccatggatggccgctacccactcaccgcctgcgatcagaatgggcaagcaatcggccgtgataatcgcaatcggctggcggctgcgggtgaacaccccgtcggcctcaaccgtattggccaactgacccggttgccactcgatcaccgacgcgctgtgcacttgtttgcaaatgaacacgtcatcgggtcgcagcggatcatcaatcgagcaaaaaccgtgatcgacgccggggagggcattgaggttatgggctttgtgcaccgtgcattctcctttgatcaaaacaccctagtcgcccagcgcctcgccttcgcgccgagggtcggcgccgccgctcagcgacaccttgccctgggcatcccgcgtgcgcacgatggcctggacgccgctggtcatctcgatttcgctgagggcatggcctttgtctttgagcgcctgtttcagcgcggggctgaacagaccggtttccaattcagtggccccgttgcggctgccgaaattcggcaggctgatggctgcttggggatcaagtttccagtcgagcatggccaccagggatttgctcacgtactcgatgatctgcgaaccgccgggggagccgacggtggccagcagctcacccgtctggcggtcgaacaccaaggtcggtgccatggccgaacgcgggcgcttgcccggttgcacgcggttggcgacaggctggccgttttcctcggggatgaacgagaagtcggtcatctggttgttgagcaaaaagccctgcaccatcacatgggaaccgaacgccgcttccaccgtggttgtcatcgataccgcaccgccatggtcgtccaccgccaccacttgcgaggtggagatgcgcagcggcgagcggtctggcgcataggccacttgcacgccagcgggttggccgggcttggcgacgcccatgctgcgttcaccgatcagcgcggcacgctgggccaggtaattgggcgcgacgaggccggcaaccggtacgggggtgaagtccgcatcggccacgtacagtgcacggtcggcaaaggccaggcgcccggcttcggcgatcaggtgtaccgcttcggctgtcggctcaagcccggccggcgtggcactcttgaccggtgtcatcggcgcgatagccaagcgagggtcgcgggtttccagtgcctgcaaagtcccaaggatctgcgccacagcaatcccgcccgaggaaggcggcggcatgccgcagaccttccactgtttgtagtcggtacacaaaggtgcgcgttccttggcgctgtagctcttgaggtcggccacggacaggctgccggcattgtgattgccccgcaccttgcgtgcgatctcatcggcaatcggcccgtggtacagcgcgtccggcccttccttggcgatgcgcttgaacaccgcggccagcgctggatttttcagcagcgtgccggtggcttttggcgagccgtcggcattcaggaagtacgccgccatctccggcgattgtgcgataaagcggtcagccgcgatcaagctgtgcaggcgcggggaaatagcgaagccttgttccgacaagcggatcgccggctcaaacagcttggcccattgcagatggccgctcttcttgtgcgccatctccaaggcgcgcaataccccaggcgtgcccaccgagcgcccgccaatctgagcatcggtgaaggccatctgcgtgccgtcggcgttcaggaataggcgttcggtcgcacccgccggcgcggtctcgcggccatcgtaggcatacaccttttgcccatcccacagcatgatgaacgcaccgccgccgacaccggaagactgcggttccaccaaggtcagcaccgcctgcatggcaatcgccgcatcgatggccgaaccgccctggcgcaacatctcacgcccggcttcggcggccagcgggttggcggcagcggccatgtggcgttcggcgtggcgggtgctgaggtcggtgcgatagcccgaacccagctccggggccggtggttgttcggtgacggcagtgtggcaggccgcgagggccagggctgttgcgatgaccgtcaggtggcggcgggaaatcaaaaacacgcgctgaactccgttcattttgagaatgatctgttgtccttggggtactgctttctaaaggtagatcgtgccttgcatatacagcacggccttgccggagataatcacccggtcgccctgaagttcacagcgcaactggcccttgcgctggccgccttgctcggcagtcaattgcgatttgcccaggcgctcggcccagaacggtgccagtgaggtgtgcgccgagccggtgaccgggtcttcattgacccctacattcggcccgaaccagcgcgagacaaagtcaaatcgagtgcttttggcggtgaccgcaatcccgcgtttaggtaggcccctgagtcgtgcgaaatccggcgtgagcgccgccacctgcgcttcatcttctaccagcacgatgtagtcatcggtgccaaacacctcggcattttcaattcccaacgcactcaacattccgctcggcggctcgcagcgctcaggctgtttggccgggaaatccatcgccaattcatcgccattgcgtgtcacccgcaactcgccgctgcgggtggcaaaacgaagcacttcgggtgcatcggccagcttatggatcaatacccatgccgctgccaacgtggcatggccgcacaggtccacctcgacttcgggagtgagccagcgcaactcatagaagtcgccacggggtacgaagaatgcggtttccgagaggttattttccgccgcgatattctgcagttgctcgtcgggcagccattcggtgagcgggcacaccgccgctgggttgccgccgaaggggtgttggctgaaggcgtcgacctggtagatgtccagtttcaccgtgaagcactccgtgtgtgaagggaggctggacactaacagcggggtagggaagcgtcaaaatacagttgggacgtttttttgcgcgcataaaaaaacggcctacctttcggtaagccgtttttagtacttggtggctacacagggacttgaaccccggaccccagcattatgaatgctatgctctaaccaactgagctatgtagccaagtggcgcgcattattcgcctggaacggcaatgcgtcaagcctttttgtcgaaaatttttctacgctttcaactgtttaacggaaagtgctgctttgggcgacgggcggcagggggatgtacgcctctcatgcgtcaacccgatcctttttagatgcaggcttgatcatcagagtgtggggcggggagtagagcgtgatcgccgcgacaagagtggatggttttggatcgggcgggacttgcgaacgatttccatcgtgccacgcttgacggtgttgggcagatatccctgtcgcccaacgcttgaccggttaaatcagattactgatgcattgtattgtgagtgacccgcttgagttgctcacgtgcccgagacaggcgcgagcgaacggtgccgataggtatatctaaaacgtcggcagtgtcttgatagctgccgtcggtctccagcgaggcgtataaggttttgcgcatctctgctggtaagtgatcaatagcgctcagggtattttccaggcgccggttgatctcaaactcccagtccaggctattgttttcttcctggccatgccacaacgattcatcgaattcgcaatgcgcaggcttggcatacatacgtctaaagtgattgcggatcaggttctgcgcgatgccgcacatccaggtgctgagcgttgcagtgccactgaaacgctcgcgattacgccaggcttccaagtaggtcaattgtagaaggtcatccgcatcttccgggttgagcacgcgtttgtgaatgaagcgacggagttttttctgttggtcgtctgtcaggtgaagcatgaattgaggcgagctgccaacaaggtgagctatagctccaatagggatattcatgatgttttccttaaggtagacgctgtcgaaatgatttcgacggctacctcttttgcaccgcctgtgccaacggagaatcctctattaaccaactgatttatataaataaatactttatcggcatggcacttttgtgcagtagtttgcaaaaggcatcagaggctcgtgcaggttttttcacgctgtcggtgggccagatttcgatggaaccatctgcgcgggctctgccacacagggacactctcttcctgtactggcctgcccatgaaagtcgaatccaccaacgaagtgccaacgccccctcgattggaactgaacaccgtcagcccggccgccaagcctgagccgggcaaaggtatcgatgatctttttctgcaattcagccaggagatagagcccaatagccgcacgttggacaaacgcaaaatcggggtgcgtgtgcccccggtccaggcgttcgcgcagctgtatgagcagctgggtcatccggcccaggaaagtttttcggcgattgcacgacggatcaggctgcaattgctgatgcagcccagcgtagataaattgctggaatccactggcggtgacccggctcgtacctttgtggtactaaagtcggtgttggagcaggccgatgctgaagcgcgcaaatccgaagccgccctggcgcgggatgccattgccaagttggagatccgcttcaaaggccagatccaggcaggcctgaatattgccgtggccttgcagaaggccggtggcgatccccaggagcgccaggcgctgcgcgcgctctattacgccagtgtggtgacgcggcaatccctggcgagcatgatgcaggcgctgttgggcgtttacggcgacgaccgctttgcccatgggctgaacgtgatgtccagtgccttgaccgccgacatcgctgcccatgtctcgtctctgcctacggcaatgttgcgcaccctgctggtggggctgcgtagttgcggtgcattgagcggggtgttgtgcagctgccgtgacttgacccagaacctggcgattgagctgcatgcggtaaacctgctgcagcgcctgctgggctacgccagcaccggcattgcctcaaatgaagtgatgcgcctggccgaagacatggggggcaacacgtccacgcttgtgtctctgaatacgctttacccactgtttcaaagcttgccgctggcgctatggccggatagccggtctcgccaagaggcgctgcataatttcctgttggtgatggatgagcttgcccgtcaagaaggcaagaaccctcgctttcccgactcgagcattctggcgtgagcgtgctgtccaccatcaacggcatactgctcaagctggcgcagcgtgccgaggtcttgggcgccgtggtgatcatggcgattgtgttcattttcatcgtgccgctgcccacttggctggtagacatcctgattgcactgaatatctgcatttcctgtctgctaatcatgctggcgctgtacttgcccgggcctttggcattttcttccttcccgtcgattctgctgctgaccaccatgtttcgcctggcgctgtcgatcgccacgacacgactgatcctgcttgaacaggacgccggcgatatcgtcgaggccttcggcaacttcgtggtaggcggcaacctggcggtgggtatggtcatcttcctgatcctgaccctggtcaacttcctggtcatcaccaagggctccgagcgggttgccgaagtggcagcacgcttcagcctggacgcaatgcctggcaagcagatgtccatcgacagtgacttgcgtgctggcttgatcgacggcgagcaagcgcgcgacaagcgtgaacagttgtctcgcgagagccagttgttcggtgcgatggatggcgccatgaaattcgtcaagggcgacgccatcgctgggttgatcattgtggtggtcaacctgctgggcgggttttccacggggatgttccagcacggattgagcgctgccgattcaatggcgctgtattcggtactgaccatcggtgacggcttgattgcgcagatccccgcgctgctgatctccctgaccgccggcatgatcattacccgtgtggcaccggacaggcacaagggcgtcacgaacatgggtgctgaaatcgcccggcagatgaccagcgaacccaggagctggatgatcgcatcggtggcgatgctggtgtttgcgatcgtgcctggcatgccgaccctggtgtttatcctgatctcgataatgacaggcgccctgggttattaccttgaccgtcggcgtcgtaggcaagcgcagccagaagccgaagccgtcgaggccccgcggcccgaagaaaacggcaaggaggacttgcgcgggttcgatccgtcccggccctacctgttgcagtttccctcggccttgcgaggaacgcctgaggtgacggatctcattcatggaatccgtcaggtgcgaaactccctggttgccaatatcggcctgacattgccgccgtttgaggtcgagatcgatgactcactggccgccgatgagatgcgcttctgcgtgcatgaagtgcctatggtcaaggcgtcggtggtccagcgagtggccgtggctcgcgctgcgcttacggttgagcctgagcatggcataccgggattggccgagcgcaatgaacaggattggctctggctgccacctgatgacccattgcttgatgactcgcagctggagcgcttcagtgcgacgagcttgatcgtcgagcgcatgaagcaggcgatgatgctcagcgggccgcagttcctggggatccaggagagcaaggcaatcctcagttggcttgaacacaatcaacctgaactggtgcaggaactgcaacgcatcatgccgatatcgcgcttttctgcggtgttgcaacgcctggccagcgaaggggttccgctgcgcgccgtgaggctgattgtcgagtcgctgatcgagtatggccagcatgagcgcgagccggaagcgctggccgactatgcgcgcattgccctcaagtcgcagatattccaccagtacagcgaggccgatggcctgcatgcctggttgttatcaccgcataccgaaaacaccctgcgtgaggctctgcgccagacccagacgggagtgttctttgcactcgacagcgatgacagcgcagcgatggtcaacctgcttaacagggccttcagtgcccgggccaaaactaaaagcgtgatgttggtggcgcaagacttgcgtagccctttacggaccttgttgcttgaggagttcaaccatgtgccggtgctgtccttcgccgagctggggagcaattccaaggtgaaggtgctggggcgttttgatcttagccaggatgagttgatgcacgggacgttggcatgaacacatcgctacttgagtatggggggacgcactgatgttcgaactccgggtgttggacggtttgcaccaaggggccgcgctgcctttgtttggcgagcaatggagccttggcgcccacggggatgccgatcttttgctggatgatccaggtatcgccgagcatcacgcgcgcctgctgttggccgatggccggtggtcggtgcaggctgaggctgggctgttgaaaaacagcgatgggcaaatgttggcgcaaatcagcgacctggcgctcaacactgcgtttgtaattggcagtgtcagcttgtgtgtcagcccggctgatcagccttggctgcaagcgtcggcgcccaagcaagacaggcaggtagcgcaacctgaaccccagacgttgccattgaccctgtcgtccatttcgtcgacgcagcaaaaaggcctggtaagcctacttctgttatgcgccgcaatcatcatggcggttggtattatcttcagtggcgagcgcgaggcccaggcatcgctgatgccggcagtgattcagaagcccgggctggattcgcccgccgaggtgcgccagcaactgatgaagatgctcaccgagcgcgagctgctccagcgtgtcagcttgcagatcgtcaatgaccagatagccctcaatggtgtcgtttcccaggaagaagtggaactgatcgcgcgtatgctcgaccgttttgccgagcagttcgataccggcgtgccggtgatcagccgcgtacgggttcgcgacgtcaggttgccgttcaggatcttgcagattgtcggtggcccgaacggccatgtggtgcttgaggagggaacccggctgttcgtgggcgatgaagtggatgggctgcgcctggtattgatcgacaacagcaaagtggtgttcgacggcgagcaacgttatgaggtgggctggtgagggggtcgttgcaggagcgcctggaggcttggcagctgaaccagtcccaggcgctgagcagcttcgccccggtcacgatgcgcggacgcattcagcgcgtgaacggcatgctgctgcaatgccgattgccccaggcccgtatcggcgacctgtgccaggtcgagaaagcaccaggtgactacatgctggcggagatcatcgggttcgaccagcgcgatgcagtgctgagcgccctgggcaatctggaaggcgtgcgcgtgggtgccagcgttgagcggctgggggtgccacaccaggtacgggtcggtgatgagttgctggggcaggtgctggatggttttggtcgcccgattgcgggtgacggtgccggcgcattcgtcgaagcggacgcacctgatgcgaccccggtgttgtgcgaggcgcccctgcctacggaacggccgcggatcaaccgcgcactggcgacgggcgtgcgctcgattgatgggctgatgacgctgggggagggccagcgtgtcgggctgtttgccggtgccggttgcggcaagaccaccttgttggccgagatcgcccgtaacgtggaatgcgatgtgatcgtgttcggtctgattggtgagcggggccgggaattgcgcgagtttctcgatcacgagctggatgaacagttgcgggccaaggcggtgttggtgtgcgccacctctgaccgttcaagcatggagcgcgcgcgcgccgcgttcacggcgaccgcgctggccgagggtttccggcacaagggccagcgggtgttgttgctgatcgactccctgacccgcttcgccagggcgcaacgcgaaatcggcctggctgccggtgaacccttggggcgcggtggtttgccgccgtcggtctatagcttgttgccgcggttggtggagcgcgccgggttgacccgcgaaggtgtgatcacggctatttacacggtgctgatcgagcaggactccatgaacgatcccgtggcggatgaagtgcgctctctgctcgatggtcatatcgtcctgtcacgcaagctggccgagcgcggtcactacccggcggtcgacgtcctggccagtctttcgcggattttaagcaatgtcgctgagcccgcgcatatccgtgccggtacggcgttgcggcgcctgctgtcggcttaccagcagatcgagctgatgctcaagttgggagagtatcaacccggcaacgatgccctcaccgacctcgcagtcgacagtcggcaggcggtagacgggtttctgcgccaggacttgcgggaaccttcgccgctagccgtcaccatgaaccaactgacggagctgactgcccatgtcccattctgaaatgttatcgggtgaaatcgataccttgcgacgcctgcgccggcatcgtgccgatcgtgcggagcgtgcgttgcgtgaggcaaaacgggctcagcaagcgctggtcgcgcacatccgcgagatgcaggaggtgctcgagcggactcgccaggaagaggcccggcaatgtgcgcaactattgagcgagcaccaggggcaggtggtgacgttcaaggcgctgaagaactggagtgccaaggagcaggagttgtcggcgggcacgcagcgcgaagaacaccaattgctgcggctgcaagggcggcagcaagagcaggtggtgcaggtcaaccaggcgcaaaagcaggtcactttatgcttgcgccaagtggaaaaaattcaagagttgtctgatttactgcggcaggagccgatatgaaacaggttgcagttacgacacctgaacgtcagcgcccgcgcgatgagcgtgcccccgagttcagtgccttggtgccttgggagcaacggcgactgtttagccagttgtttgacgatgatggtcagggcgggggcggatacggagcttctctgaacggaatcaaagcgtcgggcgatgtcgccatgatcgaggcgctgaccgagcagttggcgccgcgaatgctcgtcggtccgcaatggccgttgatggcggtctttcacctcggacgccttgggcggatcaatgccgatattcgtcgagagcagggcagttggagcgttgagctggacgcggagcaagacgcttcggcgcgctggctcagtggggtacgccaacaatgtgagcaacgtctggctgcgagcatgggtcagcccgtgagtttgtacttggccagatcggcgcaggcatgatgctgccacctcttatatttcctacgttcaaggctgatatcgcggttgcccgacagcggttggggcacgggatgcgtatgccgtttgaagtcgccggctcaagtggcgagttgaaaatggagcctggtgctgcccctgtgggtatccagccgctctgtttcgaaacggcctgcggagtattggccctcagtgagccgggaccgcaattgagcttgatgggtgaatgcccggtgacactggcgcaggccggcaacgatccggatgcctggttctggtccttgttccagcatcatctgagcccccaggtgcaggcgctgtttggtcatttgcgtttgctgccgggcacccgccccttgaactttggttgccgattctgcgtgacgctcggtgcgtcccgtgttgtcggctacctgtggctatctgtcgatagctttctggcgttatgccaggcggggccttggcgttccatggctaagccaatgccgacgcagtttcaactggcgattgatgtgacgctggggcgcctgcaattgcccatgcaccagttgcgcagtgtgcgggccggtgacgtgctggtgcttgaacaggcctttttcagtgcgtcgggaactggtcatgtacaggttggcaaacggcgcctggtgggctggattgacgccgaatccgggccgatgcgcctgacccttacttctatcgaggacatgcttgtggacgaggattttgcagcacagccctactcagggcatgaggatgagacggcggtaacggatgtgttcgggcatgaacccttcgatgaattgagcatggcgctcaatgtgcgttgcggtacgttgaatctgacgctcggcgaattacgcaatcttgcaccaggcgcggtgttgggcgtctccgggtacgcccctggcacagccggactctattacggagaccgccctctcggccttggccagttggttgaagtggacgggcggctggggctgcagatgtctcgcgtgattttttctcgatgagtagtttccagggaatagatccggtcgtcctggcaatatttctcggggcgttgtcgttgatgcccatgttgttggtcgtctgcaccgcgttcctgaagatcgtgattgtgttgatgatcacccgcaacgccatcggtgtgcagcaggtgcctccggggatggcgatcaacggcattgcgctggcggccaccctgttcatcatggcgcctgtcggttacgagatggccgagatcgtcaaggtttcccccctggacctgaccagcgtgagcgcccttcaacagacggggacggaggcgatcaaaccgttgcgcacgttcatgttgcgcaatattgacccggatattctgacccacctgctggagaactccgcacgcatgtggccggcgcagatggcgcaggaagtccagcgtgaggacctgatcctgctggtgccggcctttgtactgtcacagttgcaggcggggtttgaaattggctttctgatctatatcccttttatcgtgattgacctgatcgtctccaatctcctgctcgcgctgggtatgcaaatggtatcgccgatgaccatttccctgccgctcaaattgctcttgttcgtgatggtttccgggtggtcgcgattgctcgacagcctgttcctttcctatctctgagtggcttatggaaccgatcgtactgttcaagcagggcatgctgctggtggttatgttgaccgcaccgccgctgattgtggcggtggtggtaggggtcatgacatccctggtccaggcgctgatgcaagtgcaggaccagacgctgcctttcggtatcaagctggtggcagtgggtatcactttgatcatgacggggcgctggatcggtgtggaattggtccagttgatgaacgtgaccttcgacatgatcggtcgctcggccctgcactgaggtttcgcctgtgctgctttatcttgagtatttgcccagcttgctggtcgccatggcgcgtatctacccctgtgcctttctcgtggcggcattctgtttccaacatatacgaggcatgccccggcacaccatcgtgatggtcatggcactgctgccggcgccggctgttcatgcgatgctggagggccaggaactctctgcgctgctgcttggtgggctggttctgaaagagctggccctggggattttgctcggcgtattgctgtcgatgccgttttggatgttcgagtcggttggtgcgctgttggataaccagcgtggcgccttggccggcggccagctcaacccctcgttggggccggacgcaacgccggtcgggcacttgttcaagcaactggcgatttttctattgatggccagcctggggctgggagcgttgacccaagtgatctgggacagctacctggtgtggccaccgacggtgtggtttccgctgcccgctgccgatgggttcagtacatttgtcgacctgctcggggacacctttacgcatatggtgctctatgccgcccccttcgttgcggtactgctgttgttggaattcggcattgcgctgcttggggtctacagtcagcaattacaggtgagtacgttggcgccgcccctcaagtgcctggcgggtattggtatcctgttgctgtattttgcgttgttacaggacctgatcgtcgggcgcatgggctcgctcaccgacctcaagcactccctgggagtaatgttcaaggtctcggtatcatgagtgattcaggggaaaaaaagcaccccgcgtcagccaagaaactgcgtgatcagcgtaagaaagggcaggtcgcccaaagtcaggatgtgggtaagctgctggtgctgacggccatcactgagatcgccttgttcaccgccgagaccagcctgcaacgtttccagcagttgatgttgttgccgatttcacgctcgaccctgcctttcccgcaggcgctggaagaagtgatggttgaaggcgtgatgatgtttttttcattcgcgctgctgatggccggggtggcgattattacgaagctggtcagcagttggatgcagtttgggatcctgttcgccccggacaccctgaaactcgatttcaaccgtctcaatccgctcagtcaactcaagcaaatgttctctgtacagtcactgatgaacctgttgatgagtgtgatcaaggcgacgctcctgggcctgatcctgtacgtggtgatctggccttcactgggagtattgatcaacctggccaccagcgacctgcaaagctataccctggcgttgatcgctttattccgccatttgctgcatgcctgcctggggttattgctggtgctggcacttattgacctgaccatgcagaagcacttctttgccaagcgaatgcgcatgactcaagtggaagtcgtcaaagagtacaaggatatggaaggcgacccgcatgtgaagggacaacgccgcgccttggcacagcaattggcccaggaggagccgaaggtcaagctgcccaagctggaggagtccgacatgctggtggtcaacccgacgcactttgccgtggctttgtattaccgtgccggcgaaacgccgttgcctctattggtggagaaaggtaccgatgatgacgcccgtgcgttgatcgcccgggccaagagggcggatgtgccggtgatccagtgcgtctggctggcgcgtacgctgtatacgaagaagctgggggcgaatattcctcgcgaaaccttgcaagccgtggcgttgatctaccgtaccttgcgcgagcttgatgatgaagccaagcgtgagaccctggagttgccagagcttgatctacgttgactagcgcggggtgcgtgcatccagggttgcaaggctagccagcgacaacattcggctgagggtcctgtcgaacagggtgcgctgcgggggcagcgcatgccagatcaccagggcgtcctgcgcgtcgatgtagatgaagcaaccatcgaatgccacggtttgctcgaaacggcgctccagcacctgctgtaattgtaacggtcgcaatgtttcgcgtgtcacgtgcagggccagtccttggcaggctccggcctgcatgccactgactgtcacgcccggagcgagtgtcaggtgagcggcagagccgcccaccaggctgtcgaggaagacctgacgctgatcgtccggcattccttgagcgctcatcgttccagtgacactgtctgatagtccgcccgttcccccgcggggccgggttcgacgcgcatttgcggcggccaccagatcaccagcttatccatggtcgattgggggcgtgagcaggagtcgcccttgcaggtgggcgtacagccgacgacgagcagtgccgcgccgatcagtgaggcgtatagcaagcggtgtttcatggcttggccttctgggttggagtgatcagagaggggcgcggcacgctgaggtgttcatccttcaccaccgggcgcatggcgatgaacacttctgcttcttcgcctggcttgagccaggcccgtggccagacactgacggccagggtttgtgcattactgcattccttttcgtcgatacgcacattgcgattgaactggttgcgcagcacgaccactgccacgttgtactgcgagcccgcataccactggctgcgttcggtgttcagcgccagcaggttgcgagtgctgcacagggtgttcagccccaggggcatcggcgctgccttgaaggccttgggcacttcaccgctgaccaggtgcgccagggtgctgataatgtcactgcgcttgatcaccggctggtgagggtcatagcgcctgaccagtggcgcgagagcggcctgcaattcgacctggtcggcctgcggcaagtagcgtgacgggtcggcctggtcgccaatgacgcggggcgtgaggatgaacaagcgttcacgccgattgttctgtcgttcagtcgaggaaaacagtgccttgcctaatagcgggatatcacccagcagcggtaccttgctgagtctgtccgtgctttcggtgacatggaaaccgccgactaccagtgagcgtttttccgccatgatggcctgggtgctgaccttgcctcggcgcacatcgaagctgtcgggggtggggttggcttcttcgaagttaccgtcctcgatatctaccagcagctggatttggtggcctccacggctagtaatcacgcgtggcactacctggaagctggttcctacggtaatcggtagaatcgttgcgttttccctaccgcgagacaggtattgggttcggttgaaatcgatcactgctggctggttttccagcgtcagcactgacggattggacaccatggttgccaggcccttggcctccagcgcgcgtatgtcagcctcgaagcggtcacggtttctaatggtcaactgagtgttgccgggagccacatccgctccaccactgaagcgactgttctgaaagccccacttcacaccgaattcgcgtagttgcgtgcgctcgatatcgaggatgatcgcatcgatttccaccagtttacgcgccacatcgagttgggtaatcagctctcggtacatcgcctgccgttccggcacgtcataaatcaggatggcgttattgcgcaagtcggcttcgacgcggatacgggctaggctcactggggctcgcggggtgattgacatgcctgcatcgggcgagccgttcaccgcgtttgccgcggacgaaccgagcatttgccccaacagcggattgctcaggcgtggggtcatggaggtgacgaatggaggctgcgtgctggaacgctgagtctgcgctgaaggcatcgaggttgagcgcggctccagcagcccacgaagcatggtcgccacaccggggatgatgattttttcgttgcggtattccatctggcgatccgccgcgctggcgaatttcagcggatagctcaacacgctctgtttttcatccgcggaacggcgctggctgctgaatcgcttgatctgttcgatataaaccttggggccggagaccagcacgacaccgtcctccggcaactcgccccagccgaaccgactgtcgagcaggcctatgtcggtgagcgcctgcttgagatcggaaatggtctcggacgagacctccaggcgcgcggactcttgctggtcgagggtgctgacatagagtgtgttgttgtacatgtaccattggaaacggtgctcgaccccaagccggtcgagcaatgactgcggcgtattggcgcgtatcttgccgttgacgttaccttcgagcagaccctcgacttgaagttgcgtaccaaacgtctgggcaaaatcctccagcacttcgcgtacgggcttatgctgtgcttcataagcgtaggcagtgtttttccattcgggcggaatggcggccaacgtgttgtccagcggcagcagccatccgggtagcatgatgagccagccccaggcggcgcgacgtgtggtagtagataggtgagggcgcaagcatttgtgcttgtcgattttatcaggcatgggaaggtctcttgttagtgcggtatcgagcgcagtgacgtgggaacgaatgcgcgtgcaggccgggcctggcgcgcaacgatggcgcgccaagtgtcgcgttggttaagaagggattcgaggcacttcacgggctgttcgccgtggcccatctccacacattgaacaagccaaagcgcaccggtgaggggtgactgcgccagagcaccgtgaaaatagctcaggctggggccccccaggcgcatccaagttcgtagcgaggcgttgtccgcgcccgcctttgtcaactggacctctatcagcagtttgttcgagacacgccgaaagttgatttcgtcgtcattctcgaacaatgtgagctgctcttcttggccgttcaaccagccgccaatgagtgtgtgcaacttactgcacaccatccagggctgtcttaagcagcgtatgcctggagcggacttgttcgttgaaagcgatgatggagagtttctgttgtttcactagatcgctgaaatactcgatgtcgccatcgaatgcttcagtgtctttataggcggtattcacacgcttggtgtcagattgaacctgcttcaacaggtgagtgttcaggtttccgtagaagtccatgagttttactccagatgtgtctgaactgtgtggcgggttgtttgtaaccagttccatcggcggacatgttttttaaaaatatcgctgccttcatcgctttttcgttgatgtttcctacgcgctcgcaaacaaaatttcgcgcattgatgcccagtcgatgcggaagtcgccttcctctgtttccaacagcaacgtttgaggtttgacctggtcatcaggacgaagcctccaaagcgtagagtccagtttggccagggcttgggcgatgtgatcgtgctcaagggggtggcaaaccagcgttgccttgatcggggggatttgcgtcgctaccagctgtttaatcaatgccgaaaggcgttggggctgaggcacttcctccaacaggcagtggaaggcttggttggcgatggaggtggcgtagtgctcgaggttgtcgcacatcgcctggcgttggcgctcccaggcgctgagctgcgcgttggcccgtgaccagaagtcgaggctggcctgttcaagcagttcttcgcgatgttcagccgcctggtgcaagagttcgtcggcttgggcctgggcgctacccagtagctgcccggcccgcgagcagtcggcaagcatttcccgggtaatcaaaacctttggctggccggggacaccgttgtgcaactcaattctgcgtagggtcagcatcgacaaggctccgattttttgcagttaacgatgggtgagttcgctatgcgttgcggcgatacgccagacaatcgcttgccaaagcgtattgagccggccatgggcgtcgtcaagtgacaggtatgtcctttcaattgcctgcacccgatggggggccaggcgcaaccgcagacgctgccagacagcaggttcgacccaggcccgcagcaattgcagtggatcgtcgtccggttgcagcaaggcaccgggatgcagagccttggcaaggcgttcgcaccacttgcggtgttcgtcgcacaaggggctgtcgaggttggggtggcacgtgaggtccagtagcgctattgccagatcaatctgctccggtgatgccagtgccaagccaagcaccgttgcacacggggcaggaggcagacacggctctatgcccaaggcggcacatgccagcccgggccggctgcgacacaagggcagcactgcgtcataggtgtgggcgctggttgcgtccgggtgcgaagactgccagggattggcccaccattgtgcccaagccaggtgatcactcattcgacggttgagccggggctacagctggcgttgaccgttggactctgatgcgccaaaacagcacagcgaccagcgtcagtatcgcgccggcaatcaataggccgacactggtgcgccaaaaaccgacgtcctcctcagggatcaggaaagggccgaaatagatcaatcgttgttgttcctgatagaccgaagccggcacgaaaacgaccgtaagcttttgcgcgttatccaatgcagtgctcatgccgggaatgctgctggctaccatcctgcgtacacgggccctgatactgtcgggctccaatcgcgggtcatgcttgatgaacaccgaggcggaagcaggttggacgggctcaccgggagccacgcgttcgggcagcacgacgtgcacacgagcgacgatgacgccatcgatgtttgacagggtcgcctccagctcctgggacagggcgtagatgtacctggcacgttcttccagcggcgtggagatgacgccttccttgcggaaagtatcccccattgtggcgcgggcgaccttgggcagccctacggcttcaagcgtgcgaacggcgcggctgatatcggctacattgacccggatcaccacaccgtccttggcaggcactttttgtgcgcgtatgtgtttgtcagccagttccgcgatgacttcattggcgtcttgttcggacagttggcgatgcagttcgacactttcactgcagccgcccagtatcagcgacagcgagagaacgagtccgatcgaaagaaaacgaatcattttttcctactgcaggttgctgactttttcgaggcattgcgcgcccttgccgacgcacttcaccagagtttgggtcagcaggacggagtctgaaagatgggaggcatagttgagtcgatttttttccttgaactcattgttgaagtccttgaggcctttgctcatgccacttttcgccttgtccagatgctgcaaagcgtcggtcagggcattcgatgtcggcgcggcgctaacccgttgcatcgagggttccaattgcgagctgaaaaagctcacatcttcgccttggggcgtaggctgggtaggggacctacggggtgtcaggccgctttgatattcgcgtaatacgtcgacttctattttcatatagacctccttgggaaaaccgcccttttaatgaaaagggcggtcaagcgatttaacgtattgcgtcgatgttctttttcttctcagtgatcttgaaggactcaatactttccttcaaagattcacgagctgctgctttcctttcctgcttgaggtcttcgttttctccgccgccggggctttggagagggggttggtaggtgtttgcgctggcgccagtaacattgcccatagttaaactccgctatttaagaaatgatatttgagcccgattttctagtttcagtattgatgcttccaataggtactaaatatatcaggctcgtacttatgtggctcaggcttgactatggttccaatttttacttgaaggatgtgtctggagttttcttgggtgcatatcggctgggcagtgggctactgtatttctaactgtttcatccgatagtagagcgttcgcttcgccatgcccaactctgccgccacctcgtccacgcagtaggaatggcgtctcaaagcctcttcaatcagggctttctcgatttgttgcaggcgttctttcaggttcgttggcgcgtttgtagcgttcgagggggagtctgaaagcggcgccagtcccagcacgaatcgcttggcagtggagcgcagttcacgcacattccccagccaaggatggcacagcaactgttggaccagctcgctgcaaggggctggggccaggcacttatagtgctcggcttcctcttgaatcatattcaggaacaacgggacgattcggtcacggcggttacgcagcggaggaagattgatgttcaccacgctcaggcggaaatacaagtcgcgcctgaatttcccttgctcgaccatctcatgcagcgattgctgtgcagaggcgatgactcgcatgtctaccgggatgaaccgggtggagcccaggcgttcgacgccccgcgactccagcacacgtagcagcttggcttgcatggaaagtggcatgctgtcgatttcatccagatacaaggtgcccaaatgtgcggtttcgataaaccccgcgcgtgactgcactgctccggtgtaggcgccgctgttgacgccgaatagttggctctctgcaaggctttccgggatggcggcgcagttgactgcgacaaaatgaccgcgtcgacccgacaaacgatggacccgttgggcgagggtatccttgccagtgccggtttctcccagtaacaaaatatcgatatcgagcgctgcagtactcttaagcgtgcgctcgatttccaaggcttcaacggaggggaggtatgtctcatttgttattgtgtaagaagctgacatagtccaggtgctccactatcgctatcacttcactgttgatagaacgctgttggcgtgcagccagtagagcctaaataatcaaaaaagtcatcgtgtctgttaacgtgaaaaggctgaaaaataacgtgagaaatattaactatttcagtgcgctgttttgttcaagtggtttttcggtggttatagcgtgtttagcgtaggagaaaacttaaaggcgggaggattgcgtggataagtttttttagagccctggttaagtagttttttcatacgttgaatttgcacttgtttcaaatgttgaaacaaacagccacaaaaaagccgatgcaatgcatcggcttttttgttcggtacaggggttacaggtttacttatacgttgaagcggaagtgcatgacatccccatccttgacaatatagtccttgccttcaaggcgccatttaccggcttccttggtcccagcctcacccttgtactggatgaagtcgttataggcgatgacttcggcgcggatgaagcctttttcgaagtcggtgtggatcacgccggcagcctgtggcgcagtcgcaccgaccttgacggtccaggcgcggacttcttcgacaccggcggtgaagtaggtctgcaggttgagcatctcgtagccggcacggatcacacggttcaggccaggctcttccaggcccagggcctcgaggaacatgtctttttcttcgccgtcatcgagctcggcgatttccgcttcgatcttgttgcataccggaacgacgatggcaccttcttcctcggcgatggccttgaccacgtcgaggagcgggttgttctcgaagccgtcttcggcaacgttggcgatgtacatcaccggcttggtggtcagcaggtggaagcccttgatcacagccttctcgtcagtgcccatggtcttcatcaggctgcgtgccggcttgccttcggtgaagtgagcgatcaactgctccagcaggcccttctggaccacggcatccttgtcaccacccttggcgttgcgtgcgactttctgcagttgcttttcgcagctgtcgaggtcggcgaagatcagttccagatcgatgatctcgatgtcgcgtttcgggtcgacgctgttggagacgtggatcacgttctcgtcttcaaagcagcggaccacgtgggcgatggcgtcggtttcacggatgttggccaggaacttgttgcccagaccttcgcctttcgaggcaccggcgaccaggccagcgatgtcgacgaattccatggtggtcggcaggatgcgcttggggttgacgattgccgccaaagcttccaggcgtgggtccggcatcggcacgataccgctgttgggctcgatggtgcagaaggggaagttctctgccgcaataccggacttggtcagggcgttgaacagggtagatttgccgacgttgggcaggccgacgatgccgcaattgaatcccatggtgtttcccctcgggtaagagtcaggccttctggctgtgcaggtttttcatcgcgcggttccattcaccggcgaagatatccggcagcacgccgagggcaaaatcgatgctggcatcgagtttttcctgttcggcgcgtggcgcacgacccaggacgaaatttgaaaccatactggcaacgcctgggtggccaatgccgagccgcagacggtaaaaggtattctgattgcccaactgcgcgatgatgtcacgcaggccattgtgcccgccatgcccgccgccttgcttgagcttggcaaccccgggtggcaggtccagttcgtcatgggccaccaggatttcttcgggtttgatccggaagaagcccgcaagcgccgcgacagcctggccgctgcggttcatgtaggtggtgggaatcagcagacgaacatcctgaccctggtgcgaaaagcgcccggtcaggccgaaatatttgcgatcggccacaagattgacgccttgggcgtgggcgatgcgctcaacaaaaagggcccctgcgttatgccgggtctgttcgtattcggcgcctggatttcccaggccaacgatcagtttaatggcagtcacgacaggggcccttcctttggagttgtggataacatcgctacaccggcgtgcggcgaaagtggacgacaggagctcacttatccagagataaacttcgcgttgttgcccgctttctcgctacgttcggtccgcgatgttccctcaagctccttcgttgcagagtgtattactcggcagcggtttcgccggcttcatcttctgctacaacacgtggcgcgtggacgttggcaacagccttgtcgtcgttgtgagccagtgcaacgaactcaacgcctttaggggccttgaggtcggacaggtggatgatggtgccgatttcagcagccgacaggtcgacttcgatgaactcaggcaggtctttcggcaggcagcttacttccagctcggtagtggtgtgggaaacaacgccacctttcttgaccggagcttcttcaccaacaaagtgcacaggcacgatagcggtcagtttctggccggctacaacgcgtacgaagtcagcgtgcagtacgtggcccttggaagggtggcgctgcagggccttgatgataacgttctgcttcttgccgccaacgttcagttcgataacgtggctgtaggcagcatcgttttcgagcagcttggctacttctttagccagcatgctgatggactcaggggctttttcgccaccgtagactacagctggaaccaggcttgcgagacgacgcaggcggcggctcgcacctttccccaggtcggaacgcacttcagcattcagggtaaaatcgttcatgttgtatctccaaaataaccacattcgccccagcgtttgcgaccagcgctaaaggcgatatgggcaaaaaagccccgccccaacagaatgctggggcggggcgcttttcgtcagtgaggtgctccgaaggtttgacccttaacggaacatcgcgctgatcgattcttcgttgctgatgcggcgaaccgcctcggcaactaccggcgcaatatccagttgacggatacgcgaacaggcttgagcagcagcggacaacgggatggtgttagtcaccaccagttcgtccagcatagagttctcgatgttctcgatcgctcggcccgacagcacagggtgtgtgcagtaggcgaagacttttgccgcaccgtgctctttcaaggctttggccgcgtggcacagggtgccggcggtgtcgaccatgtcatcaaccagaatacaggtacgcccttcgacatcaccgatgatatgcatcacttcagagtgattggctttttcacggcgtttgtcgatgatcccgagatccacgcccagggatttggcgacagcccgtgcacgcacgacgccgccaatgtccggggacacgatcatcaggttttcaaagcgctggtcttcgatgtcatccaccaggacgggggagccgtagatgttatctaccggaatatcgaagaacccctggatttggtcagcgtgcaggtcaaccgtgagaacacggtcgatacccaccacggtcagcatgtcagcaacgactttcgcgctgatagccacacgtgcggaacgcggacggcgatcctgacgggcataaccaaagtaagggattacagctgtgattcgagtcgctgaggagcggcggaaggcatcagccatcacgacgagttccatcaggttatcgttggtcggagcgcaggtcggctgaataatgaagacgtctttaccgcggacattttcattgatctcggctgtaatttcgccgtcggagaatttaccgacagagatgtcaccgagagggatatgcagctgacgtacgacacgccgagccagatcggggttggcattccccgtaaagaccatcatcttggacacgcgcagtacctagaggctgagggtaacctggatgagtattagaaaatggcaggggcggctggattcgaaccaacgcatggcaggatcaaaacctgctgccttaccgcttggcgacgcccctgtatctgttgcaacgagtgcccagcactcgattccttttagagcagactttgcagcttgcgatgcaacatcgaaacgttgcttccctttgctacaaaccctgtaagggtctctgtaagaagggccgagactttatcagcttcagctttgcttgggaagcccccaaacacacaacttccagttccggttaattttgcttcggtaaatttacctaacaaattcaaagcgttacgtacttctggataacgccttgctacaaccggtaagcagtcatttcgactgtttcccttgggaacggggcgcactttaatgggagaagagttacgtgtcaacaacggatctgaaaaaatttctgctgtacttacagatacttgcggcacaagcacgacataccaaggttcttcgggctctacaggggtgagtttctcccccacgccttcggcaaacgcggcgtgcccacgcacgaaaaccgggacgtcggcgccgagtgtgaggcccagtgcagccaggcggtcgtggtcccagcccagttgccacaggtgattgaggcccagcaatgtggttgcggcatttgagctgccgccaccgatacctccgcccataggcaggatcttgtcgatccagatatcgatgccgagcgaggtgccagattgttgctgaagttttttcgcagccttcacaatcagattgctatcgtggggcacaccttcgaattcggtatgcagatggatcacgccatcgtcgcgtacggcgaaggtcagctcatcgccgtagtcgaggaattgaaacagcgtctgcaattcgtggtaaccgtcttcacggcgcccgaggatgtgcagcatcagattgagtttggctggcgagggcagggtcaggcgttcagtcacgttattgccccagcttgcgcggttgccagtccttgatcaccagcgtgacgtcaaggtcggtgccgtgcagcttgatgcgttcgggcagccaataaccgccttgttcaacgtagctcaagtactccacctgccaaccatcctgctccagcgtggccaggcggctatcgccgttgaggctcaggcgactcttgctatcgggcgccggcaagccgcgtacccaccagaccagatgcgagacaggcagcttccagccgatctgctgctccagcagttcttccggagagcttgcttcgtagcggccctggttggccacttccaggctcacttgccccggtcggccggtcaggcgcgccgcgccccggcccagcgggcccgagagacgaatatcgtagtagtcctggcgttgcagccagaacagggtaccgctgccagagtctttcggcgcacgaacgccgactttgccctcgatctgccagccatcgatactgctcagttggtccttgtgttgtttccattgcgccgggctgccctggccttcaacggattcgcggctgcctatgcccgcgcaaccggcgagcaaggcgatgaagctgaaaacaataatgtggcgcaagaacataagcttaaagggtctcggatccggtcaggcgcttgatggtgccgcgcaggatggggctttcgggttgttccttgaggaatttttcccagatttgtcgcgcttcgcgctgcttgcctttagcccagagcacttcgcccaggtgtgcggcaacttcttgatcgggaaaacgctccagtgcctggcgcagcaaacgctcggcttcgtcgaggttgcccaggcgatagttcacccagcccaggctatcgagcacggccgggtcttccgggttgagctggtgggcttgttcgatcaacactttggcttcggcatagcgcgtggtgcggtcggacaaggtgtaacccagggcattgagggccatggcgttgtccgggtcgcgcttgatgatcagccgcaggtctttttccagctgggccaggtcattgcgtttttccgcctgcatggcgcgggtatacagcaggttcaaatcgtcagggtattgcagcaatgcttgttgcagcagcttccaggcgcgttcgccctgcttgttggccgacaaagtctcggcctggatcaggtacagctggatagcgtagtccggctcagcatcgcgggccgcggccaggcgtttttccgcctcgtcggtacggccgttgctcatcaggatgtcggcctggcgcagttgggccggcaggtagtcgttgccggggccgacctgggcgtattccagcagagctgcctgcgggtcgttgcgctcttcggcgatgcggccaaggttcaggtgcgccgagtccacgtggctgtcacgctcgatcagctcttccaggtagcccttggcctcatcccaggccttggcttccaggcagaccagtgccagggaataacgcagttcgtcgtcgtccgggtattgctggaccagattggcgaactgcactttggcgtcctccatgcggtcctgctccaccagcatgcgtgcgtaagtcaggcgcaggcgcttatcgtccgggtatttcttgatgcttttttccagcagcggaatcgcttccttgccgcggttgaggttttgcagcaggcgtgcgcgcagcaggatcggcgcgatctcgccgtcttccggtgggttttgttccagcaacttgagtgcggcgtcggcttcgtcatcctgttgcaacaacagggccttgccgaacaccagttggctgttcttcgggtgtttttgcagcaggcggtcgaaacttttcatcaggccattgcgcgtgtcctggtcggtgtcggcggccgacagcgcaaggaagtcgaaatgtgtgtcgcccttgccctgcaggactttctccatatagaccatagagtcgtcataacggcccgcacgtgccaattgcaccgcagctgcacgttgggcttccaggtcgtccggggcgttttttgcccagatcagcgaagtgtccagcgcagcctggtcggcgcccaggtattcggcgatgcgaaaggctcgttcggagatgcccgggtcctgggtgttgatggcctgggttacataattatccagcgcaatatcaaaacgattgcgctggccggccaattcagcggtcagcaggctgtagatcgtttcttcactgaacgaggaataaaccttggccttttcaggggcgggggggctgtcttccgccggcggcgcagcgtccggcgaaacgggtgccatggcctggcagccgctgaggaagacaaaagcaaggagcaacgcggaagatctattcatataggaagaggacgactaacctgcggtcggatcatcatgacacaagccttcggccaaacataaccggggcactcggaatacgactattgctgcctttgtaggagcgagctcgctcgcgaagatcgtcaacgatagcgcggcaagcctggcactcagctgtattgctacgtttttcgcgagcaagctcgctcctgcagggtgcatttataggcataaggtatagggacaatagacgacggtggttgttctggatctttcgaagtaggacaattgtcggcttcccgacatcatcagcgatattgaatggccttcctcgcactcggtattaaccacaagactgcctccgtagacgtgcgcgagcgcgtggcgtttacgccagagcagttggttgaggccctgcagcagctctgccggctcaccgacagccgcgaagctgcgatcctttcgacctgcaatcgcagcgagctctatatagagcaggaacatctttgcgcggatgtcgtactgcgctggctggccgattatcaccatttgagcctcgatgacctgcgcgccagtgcctatgtgcatgaagaggatgcggcagttcgtcacatgatgcgcgtggcggccggcctcgattcgctggtgctgggcgagccgcagattcttggccagatgaaatccgcctatgccgtggcgcgtgaggccggcactgtcggcccgttgctgggccggctgttccaggctacgttcaattccgccaagcaggtgcgcaccgacacggctatcggcgaaaacccggtttccgtggcctttgccgccgtgagcctggccaagcagattttcagcgatttgcagcgtagccaggccttgctgattggcgccggggaaaccatcaccctggtggcccgtcacctgcatgacctgggcgtgaagcgtattgtggtcgccaaccgtacccttgaacgagcgagtatccttgccgagcagttcggtgcccacgccgtgctgctgtcggatatcccggctgaattggtacgcagtgatatcgtcatcagctccaccgccagccagttgccgatccttggcaagggcgcggtcgaaagcgcgttgaagctgcgcaagcacaagccgatcttcatggtggacatcgccgttccccgggatatcgaacccgaagtcggcgagttggacgacgtttacctctatagcgtcgacgatctgcatgaggtggttgccgagaacctcaagagccgccagggcgccgcccaggccgccgaggaaatggtcagcgtcggcgccgaagatttcatggtgcgcctgcgtgaattggcggcggtggatgtgctcaaggcgtatcgtcagcagggcgaacgcctgcgtgatgaagagttgctcaaggcccagcggatgctggccaacggcagcggcgccgaagaggtgctgatgcaattggcccgtggcctgaccaacaagctgctccacgctcccagcgtccagttgaaaaagcttactgccgaaggccgcctcgatgcgctggccatggcccaggaactctttgccctcggtgagggcgcgtcagacagctcttcggataaaaaaccgcaatgaaagcgtcactgctcaataaactggacgtgctccaggaccgtttcgaagaactgaccgccttgctcggcgatggcgaggtcatttctgatcaggccaagttccgtgcttattccaaggaatacgcagaagttgaacccattgtagctacctacaaaagcctcaccaaagtgcaggccgaccttgaaggcgcccaggcgctgctcaaggacagcgaccctgacatgcgtgaaatggccgtggaagaagtccgcgaagccaaggaaaagctcgccgagctggaaggcgacctgcaacgcatgctgttgcccaaggacccgaacgacgggcgcaacgtgtacctcgaaatccgtgccggcaccggtggcgacgaggccgcgattttctccggcgatctgtttcgcatgtactcgcgctatgccgaacgacgcggctggcgggtcgagatcctgtccgagaacgaaggtgaacacggcggctataaagaagtcattgcacgggtcgaaggtgacaacgtctatggcaagctgaaattcgaatccggcgcccaccgcgtacaacgtgtaccggcgacagagtcccagggccgtatccacacctcggcgtgcaccgtggcggtgctgcccgagccggacgagcaggaggccatcgagatcaacccggcggacttgcgcgtggatacctaccgctcatccggtgcgggtggccagcacgtcaacaaaaccgattcggcaatccgtatcactcacttgccgtcgggcatcgtggtggagtgccaggaagaacgctcccagcacaagaaccgtgcgcgggccatgtcctggctgtcggccaagctgaacgaccagcagaccagcgccgccgccaacgcgattgccagcgagcgcaagctgctggtgggctcgggcgaccgttccgagcgtatccgtacctacaactttgcccagggccgggtcaccgaccatcgggtcaacctgaccctatactccctggacgagattctcgccggtggcgtggatgcggtgatcgagccgttgctcgccgaataccaggccgatcaactggcggcgataggtgaataaatgaccatcattgccagcctgctgcgtgccgccgacctgcccgattcgccgactgcgcgcctcgacgtggagttgctgctggccgctgccttgggcaagtcgcgcagctacctgcacacctggccggaaaagatcgtcagcagcgaagatgcgctgacctttgccggctacctgcagcgccgccgcagcggtgagccggtggcgtatatcctcggccagcagggcttctggaagctcgacctggaggtcgcgccgcacacgttgatcccgcgtccggaaacagaactgctggtggaggccgccctggagttgctgcccgccacgcccgccaacgtcctcgacctgggcaccggcagtggcgccatcgccttagcgttggccagcgaacgcccggcctggcaggtcacggccgtcgaccgcgtgctggaagcagtggccctggccgagcgcaaccgccagcgcctgcacctcaataacgccacggtgctgaacagccattggttcagcgccctgcaaggccacagctttgacctgatcatcagcaacccgccgtacattgctgacaatgatccgcacctggtggccggcgatgtgcgtttcgaacccgccaccgccctggtggcgggccctgatgggctggacgatttgcgcctgatcatccagcagtccccagctcacttgcgtgccggtggctggttgttgctcgaacacggctacgaccaggccccggcggtgcgcgacctgctgctgaaccagggttttgaaagcgtacatagccgtatcgacctcggtggtcatgaacgtatcaccctggggcatcgcccatgctgaccgaccaggagctgctgcgttatagccggcagattctgttgcagcatgtcgacgtcgacggccaattgcgcctgaaacagagtcgcgcgctgatcgtcggcctgggtggcctgggcgcaccggttgcgctgtatctcgccgccgccggcgtgggcgaattgcacctggccgactttgataccgtcgacctgaccaacctgcaacgccagatcatccacgacaccgacagcgtggggcagaccaaagtcgattcggccctgcgtcgcctgagcgcgatcaacccggaaatcaccttggtcgcccatcgctccgcgctggatgccgactcgctggccgccgccgtcgccgcagtggacgtggtgcttgattgcagcgacaacttctctacccgcgaggcggtcaacgctgcctgtatcgccgccggcaagccgttgatcagtggcgcggcgattcgcctggaggggcaattgtcggtgttcgatccacggcgcgccgacagcccgtgctaccactgtttatatgggcatggcagcgacaccgaactgacctgcagcgaagccggggtagtcgggccgttagtgggcctggtcggcagcttgcaagcgctggaagccttgaaactgctggcgggttttggcgagccactggtgggccggttgttgctgatcgatgccctgaccacgcgctttcgcgagctgcgcgtcaagcgtgaccctggttgcagcgtctgcgggccccagcatggttaagggtgcgcccatcggtgtgttcgactccggcattggtggcctgacggtgctggaggaaatccagcaattattgccccatgagtcactgttgtacgtggccgactgtgggcatataccttatggcgagaaaaccccggcattcattctcgagcgttcccgttccgtcgctgagtttttccgcgagcgcggcgcgaaggcgtttgtgattgcctgtaacacggccaccgtcgccgccgttgccgatttgcgccgggactaccccgattggccgttggtcggcatggagcctgcggtcaagcccgccgctgccgccacgcgcagtggcgtcgtcggtgtgctcgctaccaccggcaccctgcaaagcgccaagtttgccgccttgctcgaccgcttcgccaccgatgtgcgagtggttacccagccgtgcccgggcctggtggagttgatcgaaaccggcgacctggacagccctgtcctgcacaggttgttgcagggctatgtcgaaccactggtcggcgccggttgcgacaccatcatcctaggttgcacccactatccctttctcaagccactgctggcgcagatgctgccccccaacattatcctcattgataccggcgccgccgtggcgcgccagctcaagcgcttattaggtgagcgcgacctgctggccgctggcgatcctgaacctgcacagttctggaccagcggtgatctgtttcacttaagaaatatcctaccgacactatggaaacagcccggaattgtgcgaagctttgcttcgtgaaaatttcgtgaaatgcgctgaaaaaagctgaacttccgtctatgcctcagcttctatagccagttagcctgtttaaaaccatataacttcgttcggaaaggatgtttcttatgaagcgcttgttctgtttggctgcgattgcggccgctgtgttgggacactctgtttcagcccaggccgctggcctggagttcgggttggggagcaccagtgattcgacgttgacctatcgactgggcctgacctcggattgggataagagctggatgcaaagcaacgttggccgtctgaccggctactggagcggcgcttatacctattgggaaggtgatgaccgtgcaggggcaagcagcctgtcgttctcgccggtgtttgtgtatgaatttgccggcgagtcggtcaaaccttatatcgaagccggtatcggggtggcactgttctcccgcacccgtctggaagacaacaacatcggccaatcttttcagttcgaagaccgcctgggtttcggcctgcgcttcaacggcgggcatgaagtgggcattcgcgccacgcactattccaacgccggtatcagcagcaataacgatggggtagagagctactcgttgcactacaccatgccgctgtaagcaatgtaggaacgagcttgctcgcgaagaacgtcaacgataacgcagtgaatctgggttgacgtggtgcgttcagatttttcgcgagcaagctcgctcctacaggtcagcgatagaccgtggcgatgccttcgcgctcttccaggcattccggcgcacccatctcaaactcccggcagatcaatggccgaagcgcgtaaatcgtgcacatcatcgtgtcccggtccagcgcggcgcaccagccgtcgtccaggcgcagcatcacttcaccgccccaatcgtcggtatcaataaagcgctgcggcacgccggtgtcggtgatcagcatgacctccaactggcagcagcaggccgcacacgtcgagcaggtgacggcaggttcggtgatttgaatatgggggatgttggtcatagacgcgcagtgtaaggcaagtcggtcaggcgcgtattaaagctcggacgggcgtcaattctccaatccccgtgcgaccctatgcagcaagggaaacagcatggcccataacaacgccaggccgatcaatgtggctggggttgcgtagccaaaactcacccccgccaactggctgcctgcgtaataagacagaggcccgcccaccgcgcccagcaggctggcaagccaccagggccgtgcgctccaggccaggcaatggcgcaaggttgtggccagcaatgcccataacaacatcaaccagaatggaatcatcggcccgggctcgctgaagtggaaaactcccagggtgcgtaatagcgtgtccagcagcgtgcctgcgagtgtcactgtcacgataagtacgccgtcatccgccggcgaacttatccacagccaatggattcccagtaccgccaagcccaccagcagccacaggctatcgccgccgagcacgcaggcaaaccagccgcactggaacagcacagcgttggccaagggtttaagcactgaagcgcccgagcaacggcgggttgatcgccgccggtttggccaacagcaattgcgccgtaccaatggtgcgttccatgaagccgccctcgcagtagcacaggtaaaactcccacaaacgcaggaagtactcgtcgtagcccaattcggtgaggcggccatgggcgcgacgaaagttctcatgccacaggcgcagggtgcgtgcgtagtgcaggccgaagtcttccatgtgcaacaggttcatgtctgtgtcgcggctgacgatctgcagcatgttttgtacacagggcaaggcgccgccagggaagatatagcgctggataaagtcgacgctgcgcttggcctgctcgaagcgttgttcgcggatggtgatggcttgtagcagcatcaggccgtcgggcttgagcaaatgggcacattgcttgaaataggtgggcaggaagcgatggcccactgcttcgatcatttcgatcgataccagcttgtcgtacgtgccggtgaggtcacggtagtcgcttagcagcaaggtcacttgatcttgcaggcccagtgcctggatgcgttgcgcggtgtaggcgaactgctccttggacaaggtcgtggtggtgaccttgcaaccgtagtgctgcgccgcatacagcgccatgctgccccagccggtgccgatttccagcagatgatcgctgggcttgagcgccagcttctggcagatacgcgccaacttgttcagttgcgcctgttccagggtgtcatcgggcgtcaggaactgcgccgccgagtacatcatggtggggtcgaggaactcttcgaacaggtcgttgcccaggtcataatgggcggcaatgtttttctgcgcacccttgcgcgtgttgcggttgagccaatgcaagccttgggtgaacggccgggccaggcgtgccaggccaccctccatggcgtcgagaacgtccaggttgctgaccatcacccggaccacggcggtaaggtccgggctggtccagtaaccgtggataaacgcttcgccggcaccgattgaaccattggccgccaccaggccccaggccgccgagtcgagaatctggatctcccccagcaggtgcgcttcccgggcgccgaagacttgccgctcgccgtcttcgatgatcaccaactgaccatgacgcaattggctgagctggcgcagcacgcccttgcgtaacagggcggcggtcacaccgttgacgttcaggcggttggccttgaccgataagctaggggatttcatggtggcgatccttggtgtacccgactgcggtgcgagagacgccgtcggcggctcggtgggaaaaaatcggtgtgcgcttgagcaacaggcgcaaggcttgccagtagatcgccaggcaagtcttggcagtcatccagggaaaacgccataaataaccatgcaggctcgcgcggctcagaggttggcgttccaggctcagggtggcgtcgaagagtttttgcgtgccctgccagtcggccatgtgcacgccgagcctggcggcgggcgggctgaaactcatgcggtattcaaggtcgcgaggcaaaaagggcgacacatgaaaagccttggccacggcgaaatgctggtgctcaccggcggcgagcgcctgggccggcagcacgtagtgatagcgctcgcgccagggggtgttggtcacttcacacaggatcgcggccaatcgtccgtcggcctcgaagcagtagaagaaactcacaggattaaaagccaggccccaactgcgggcctgggtcagtaggcagataacgccctggggtgtacgccccagtgccttgccgacttcgtggcgcacggcatcgctcaagctcatgccgtggcgggtgaattcacgcaggtagtcctgctggcggaaaccgaagggcgccaagcgacttcggccggccaggggcgacagcccaagcacttcattctcttcactgaggtccaggtacagcaggccgatgcggtagcgaaaggcgtgggccttgggcgcaaaccggcgatgggcgatccagccgctgtacagggcgctgttcacagggtttccccaaaggcttgggctacgcgcagggcgctgaccacaccgtcttcgtgaaagccgttggcccagtaggcaccgcagtagaaggtgttgcgcgcaccgtgcagttcttcccagcgggcttgagcggccacggcggccaggctgtactgcggatgggcataggtgtagcgcgcaaggatcttcaacgggttgatcatctgcgtctggttgaggctgacgcaaaaggtggtggcgctgtcgataccttgcagaatgttcatgtcgtaggtcacagcggcctggggctgctggttgccggtcagccggtaattccagctggcccaggccaatttgcgctcgggtagcaggcgcgtatcggtgtgcagcaccacgtcgttgttggcgtagggcagggcgccgaggatctcctgttcagcctggctgggatcggcgagcaaggccagggcctgatcgctgtggcaggcgaacaccacacggtcgaaggtttcgctgccggcgggactgtggataaccacgccatcgtccgtgcgttgcaccttatgcacagggcaattgagtcgtatctgttcgataaagctgcgggtcagcggttcgatatagcagctggagccgccttcgatcacgcaccattgcgggcggttgctcaccgagagcaagccgtggttcttgaagaagcgcacaaagaactgcagcggaaagttgagcatgtcggccagggacatcgaccagatcgccgcgcccatcggcacgatgtagtgccggataaacctggggccataaccgccggctgcgaggtagtcgccgagggtcatctcggcgctgatgcgctgcgcttgcaggtccaggggggcctggcggttgaagcgcaggatatcgcgcaacatgccccagaagcccggcgacagaagattgcggcgctgggcaaacaggctgttaaggttgttgccgttgtactcgaaaccggtgctttggtcgcacaccgaaaaactcatctcggtgggtttgaattggacgccaatctggcccagcaggcggatgaaattagggtaggtccagtcattgaacacgatgaagcctgtatctaccgcatagctttttccctcaaccgtcacgttggccgtatgggtatgcccgccgatgcaatcacccgcttcgaacaacgtaatgtcgtggcggcggctgagcagataggcgctggtcagcccggcgataccgctgccgatgatggcgatcttcacagatcgtccttgtgcggcggtgggctgcgcagcatgcgcttgccgatgatcaattgcgcccggttgggcagcttggacaacggccacagggtggcgatgaacatcgccgggaaagcgatctccagcgggcgcttttccagttttgcaaagatatgccgcgctgccttgttggcggaccaactcaggggcatcgggaaatcattgcgctcggtcagcggcgtgtccacaaagccagggctgatcaccgtgacgtcgatgttttccggcgacaggctgatgcgcagggattcgaacaggtagcgcagcccggccttggacgcgccataggcttcggcgcggggcattggcaggtaagtcacggcgctggctacgcccaccaggtgcggggtaagcccggcacgcaacagcggcagcgcggcctcgatgcaataactgctggccagcagattggtgcgcactacgtgctcgatgatcgaggagtcaaattgccgggcgtcgacatattcacaggtgccggcattaaggatcaccgtgtccagggcaccccaggcctcgccgatacgttcaccgatctcgcgcacggtctggctgttggtcaggtcgccggccaccaccagcacttgccccggatagcgatgggcgagcgcttccagcgggcctttggtgcgggagctgagtgccacgtgggcgccgctgttgagcaactccacggccagcgcggcaccgatgccactgctggcgccggtcagccaataacgtcggggtgcaaggctcatcccattctccttttcaaccaactgacgatacgtccgagtaccggtacgtgttcatagagcagggcaccggcatcgaaatagtcacgatgacgatagaccttgtcgtgccacatcaaatgggaacagccctgcacttgaatcaccttgccgcccgagaggcgcgggtggcgaaacttcatggtccagcgcaggtaaccttcgccttcggccacggcatcgaagccgtggaagtcgaactgcagttggctgacgttgctgtacaactcggtgacgtagcgccgcagcgcaggcagaccatggacttcatgcagtgggtcggtaaacgcgatgtcctcgctgtacaggctgtcgagcagatgcaggttttgcttgtccagcgtggcgaagctgtgggcgaagcggcgcaggaagtcactcatgatcggccatctcctggcgtgaaggcaggctgcgaaaggccgccaaggcacgctcccgggactgcttcaggtcgacgatggccggcgggtagtctgccgcgccaaacaagccggccgctgcggggttatgcacctcttttttgttcagagcggcgagctccggcagccagcgcttgatgaagaggccgtcgccgtcgaatttttccgattggctcagcgggctgaaaatccggaagtacggtgccgagtcggtgccggtcgatgaactccactgccaaccgccgttgttggccgcgaggtcgccgtcgatcaggtgccgcatgaagaagcgctcaccttcgcgccagtcgatcagcaggttcttggtcaggaacatcgccacgaccatgcgcagacgattgtgcatccaaccggtttccagcagttggcgcatggccgcgtcgatgatcggcaggccggtgcgcgcctgttgccaggccgccaaatcctcaggtgcgtcgcgccagactagcgcttcggtttccgggcgaaaggcgcggtgccgggatacccgggggtagccgaccaggatatgtttgtagaactcgcgccacagcaactcattgatccaggtgatggcgccgatgtcgccgctctcgaactcgccctggttggtttgtagcgcggcgtgcaggcactggcgcggcgacaccaccccggcggcgaggtaggcggacaactggctggtgccgggtttggctgggaagtcgcgctcgtccttgtaatagctgatctgctggtcggcgaaggcgtcgagacggcgacgcgcttcgtcttcaccggcgggccagagggcgcgcaagctgtcgctgggcggctcgaaacctgccaccgttgtcggcacaggatcgctttgcaactcaagcctggcctgtgccttgggcgttgccaccaggcggggcagggcagtgtgcaggcggttgtagcagactttgcggaactggctgaacacctggaagtaggttccggtcttggtcagtacgctgcccggctggaacaacagctggtccagatagctgtgaaaggtcaccccgctcgcttccagggccttggccacggcagcatcgcgctggctttcgtggatgccgtattcctcgttgacgtgcaccgattcaaccgacagttgccggcatacttcgctcagcactttcggtgcctggtcccaggtcgccgcgtggcggatcagcagcgggatgttcagtttgtccagcgcctggcccaactgccgcaggttgcgcagccagaagtcaactttgcacggcgcgtcatcatgggccagccactgctcgggcgtgaccaggtaaatggccgcgaccgggccgcgctggctcgcggcagccagggctgtattgtcgtgcaggcgcaggtcggtgcgcagccagatcaaatgcatttagacaattccacgctggatcagtaactggtgggccgacaacggatcttcggccacggacaattcagggatctcaagggttaatgcggccaactcggcgtggtggatgcacaccgttgagccggcaatcaatattgggcaactgacgccgcccaatagttttgtgagtgccgacaaatggagggccttgcttgagtacagcagcacggcacgcggttgcagatgctcgaccgccagtgccaattcgccggccggcagcggccagtcaaatacttccactgggcaatcggcactgctggccagccaggcgctgagccacaagtgcggttccagtggcaagtcggaatggttgatcagcagcagcggtgcgccgtgaagctggcgattgttgtgataaatccgcgcgccgaacttgctgcgcagccaggacaggaaaaacacccgctccatctgcgcgccgaactggccctgccaacgctgctccagctccctgagcagcggcagcatcaattgttcgcacaaggtacgcggcgggtagagcgccatggcttggttgaaagcatcgtcgacccggcgttccgccagctcgctgatggcactgagcagatgctggcgcaggctgtgccattcgttttccatcggctcggcattgggttgggccgaatcgatcaaatccttgacctggctgaccggcacgccgcgattgagccatgtgaggatggtatggatgcgttgcacgtgtccggcgctgaacagccgatgccccttgggcgtgcgctggggcacgatcaggccgtagcggcgttcccaggcgcgcagggtcacggcgttgacgccggtctggcgtgccacttcgcggatcggcaaccagccgttttccagggccagggcaatgtcttcgccgggttcgtcgagcaaggcagggttcatgggttagatcgcattacgcaggctgaggttttccgggtgcggttgcaggtaggcctgttgcgcgatgtaacggtccggatgttggcgaaagtgatgcttgagcagggtcagcggcaccaccagcggcacaatgccgtggcggtattggccgatgacggtctgcatttcctgtttgtcatcgtcgctgatggcctgcttgaggtagccgctgatgtgttgcagtacgttggtatgagtgccgcgggtggcgcactttttcaggcctgccatcagctcgctgaagtagccgtgggccagtgcctgcagattgacttccttgcccatgctgccgagcaaatgccccaggcttttgtaatgcgcggggctgtgggccatcagcaggtatttatagcgcgagtggaacgtcagcaggcggtggcgggtgaggccctcggccagcaattgctgccaactggcgtacacgaaaacgcggctcaggaagttttcgcgcagtaccggatcattcaggcggccgtcttcttccaccggcaggttggggtggcgtgcgcagaatgcccgggcgtagataccgcgcccgccagcgtcgacaggcgtgccgttgtcgcggtacaccttgacccgttcaaggccgcaggacggcgacttctgcatgaagatgtagccgcacaggtcggtgtgttcgcgggccattcgctggccgtagtcgtccagaggctgcgtgacgttgagttcacggtttactgtgccaacggcctgcggcgcggcaggatcgcccaccaggcggatcggctcccgagggatgcccaggccgatggcgacttccgggcaaagcggcacaaaatcgaaatagtcgctgagggtctgggtgcacagcagggattgcttatgcccaccgttgaagcgcacgttttcacccaggaggcaggcactgatggcgatcttcggttttgcattgctggacataagcaaacctctgcaagaatcctgtacaagtcgaataatccgtacaactaatctcatcatagattcgatgttgtacaagtcaattaatttgtataggtttttacaggcgagctatttccagcccatatgccaggcctcagggtccttcaacgtttgccaaggcaagcgctcagcgcgtcgggtcaggatggcttgcagttcgatctccagcacagtgccttcttcatcacgaaatatttcagtgaccagaaagtgtttttccttgtggcggggctgtgctgccgtccatttcgacagcagcagtttggcggggttgatacgattcattgcgagtgttcgatcaagcgccgcgccgcttcctggccgctgagccaggcaccctccacgcggccggagaggcaccagtcaccgcagacgaacaagcccagatcggcgtcggccagcaccccgaattcatggctgctggacggccgggcgtagagccatcggtgtgccaggctgaatgacggcgcgggcatggcgcagtgcagtaactcagcgaacgcaccgtgcaagtgttcgatcaccgcttccttgggcaggtccagatgggccttgctccaggcgctggtggcgtgcagcacccaggtgtcgagggtggtgtcacgcccgggtttgctgcggttgcgcgccagccagtcgagggggctgtcttgcacgaaacagccttccatcggcgtatccagggggtgatcgaaggccagggcaatggcccaggtcgggtccatcttcaccccggccgcagcactcgccagcttgggcgcggcggccagcagggcagtggcctggggcgccggtgtggcgatgatcacgtggctgaaggggccgtagctgtcaccatcggcgtcgagcaggttccagtgatgcgtgccctggaacacctcagtgatacggcaaccgaattccaccggcaagtcatcaagcaacgcgcgcgtaatggcgctcatgcgcggtgtgccgacccagcggatctgttcatcgggagagggcgtcagctggccggacttgaagttgtaaagttggggcttccactgctcagcccagccgttgctttgccagcgctgcacttcgttgacgaagcgccggtcacgggcggtgaagtattgcgcgcccatgtccagcgcaccggcgtcactgcgcttgctggacatgcggccaccgctgccgcggcttttatcgaagagttgtacagcgtgccccgcgtcttgtaacgctcgggcggcggagagaccggcgatgccggtaccaatgatcgcgatgggaacagtcatgggaggcctcgttttaccgttgggtacagactacgccgacaccaatagctgtacaatattgttttttggtataagttttggcgtgcctgaatgtgtggcgtgacctatggttaaagttaaggcttaaacatccgtcacgctcgattatcaaattgatccctgcttataaaatagaccagtgagcggcggcgaaggttacatgaggagagtcccatgcatattttgctgaccggcggtaccggcctgattggccgtcaactctgcaagcactggcttgcccagggccatcgactgacggtgtggagccgacaaccagaaacggttgcccgggtgtgcggtgcgcaggtgcttggggttgctcacctgcaggaggtgatcggcacggtggacgcggtggtcaacctggcgggtgcccccattgccgatcggccttggacccacaagcgcaaggcgttgctgtggagcagtcgcatcaatctcaccgaaaccctgctagcgtggatggaaaacctggagcaaaaaccagcggtactgatctccggttccgccgtgggttggtatggcgacggcggcgagcgcgaattgactgaggccagcggcccggtattggatgatttccccagccagctgtgtattgcctgggaagaaaccgcccagcgtgccgaagccctgggcatacgtgtggtgttggtgcgcaccggcctggtgctggcggccgagggcggctttttgtcgcgcctgttgctaccgttcaaactggcgctgggcgggccgatcggcaagggccggcagtggatgccctgggtgcatatcaaggatcaaatcgccctgattgattttcttctgcacaaggaagacgccagcggtccttataatgcctgcgcgcctcacccggtgcgtaaccgcgagtttgccaagaccctgggccaggtgttgcaccgcccggcattcatgccgatgccggccttcgcgttgaaggttggtctgggagagttgtccggcctgttgctgggcgggcaaaaggcactgcccgagcggctgttggcggcgggtttcactttccagttcactgaattgcgtgcggctctggacgacttgtccagccgcctctagagataggatgttgcatgacggatcacgcgttgttactggtcaacctgggctcgccaaagtccacttcggtggccgatgtgcgcagctacctcaatcaattcctgatggatccctacgtgatcgacttgccttggccggtaaggcgcttgctggtgtcgctgatcctgatcaagcgtcccgagcaatcggcccatgcctacgcatcgatctggtgggacgagggttcgccgctggtggtgctgagccgtcgcctgcaacagcagatgaccgcgcagtggacccatggcccggtggagctggcgatgcgatatggcgagccgtccttggaaaccaccctgacgcgcttggccgcccagggcatccagaatgtcacgctggcgccgttgtatccgcagtttgccgacagcaccgtgaccacggtggtggaggaggccaagcgtgtggtgcgcgacaagaaactgaatatccagttttcgatcctgcaacccttctacgatcagccggaatatctggatgctctggtgaccagcgcccgcgctcacctggagcaggattacgatcatttgttgctgagtttccatggcttgcccgagcggcatctgaaaaagctcgaccctactggcgggcattgcttcaaggatgccgactgctgcaagaatgcgtcacctcaagtgctcgccacgtgctatcgcgcgcaatgcttcagcgttgcccgggattttgccgagcgcgccggtttgcccgatggcaaatggtcggtcgcgtttcaatcgcgcctgggtcgggcgaagtggatcgagccctacaccgaggcacgcctagaggcgttggcccagcaaggcgtgaaaaagttgctggtcatgtgcccggcatttgtcgccgactgcatcgagaccctagaagaaattggtgatcgcggtcgcgagcagtttcgcgcggcagggggcgaggagttggtgctggtgccgtgcctgaatgatgacccgcagtgggcggcggcgcttaataccctgtgcgaacgagcgcccgttgccttgtagtcaagccttgcggtgactcaaatgtgggagggggcttgctcccgatagcggtggatcagtgacagatatactgactgacacactgcgatcgggggcaagccccctcccacatctagtccaatgttcgtcagagattgagggtcaagctgactgtgaggttgcgcggctcgccggggttggcccagtacctgctgtaggagcgctcgtaatacttctcatcgaacaggttattcaggttcaaccccacggtgacattctccgtcgccttgtaatgggcgagcaaatccacggtgtggtaagccggcagttcaaaacctgtacccgcttcaccagaacgatcacccacgtaggttaacgccgcacccaggtccgaaccgcgcaacgcgccatcctggaattcatacacccccaacagactgccactgcgcttggccacgccgagaatgcggctgccggtggggatttctttgtcgcccttggtcacttcggcgtcgatatacgcgaaggcgccgatcacacgtatggcgtcggttacttgcccggtcacttgcaggtcaaagccctggctgcgggccttgcccatggcgcgattggtgtcggtcgccgggtccagggccaaaacgttttccttttcgatatgaaaggcggccagggtggcgctgagtcgctcgtcaaacagttcgctcttgatccccacctcatagcccacgccttcttctggcttgaaggatttgccaccggcatccaggccgctgtttggcttgaacgaggtggacgcgttggcaaataccccgacttgtggcgtgagttggtagagcaggccggcgcgctgggtaaaggcgtcgtgggtctggcgactcttgacgtggttgcgggcgaagtcgtcggtgctttgttcgaaatgttcgaagcgcgccccgatcatgccacgcaggcgatcagtgaagatgatctggtcttgtagattcagcgcgtggctttgggtctgttcgaagaagtcggtaccagaacgtttgccattgggtttgggctggccatagaccggtttataaatatcgatagggtagtcgccgccgatcgctgtcacgcgctccttcttgcggtagtcctcgtattcggtgccgatcagcagttcatgctgccaactgccgatatcgaacaggccgcgcagttccaactgggtgatgctgtcgtgccagcccgtggagcgttcacggtagcggcggttgacggtgtggccatccgcgttaagcgcacggctttccgacgcgtcaccccacaggctaccttgcttgtagtggctggccaggcgcagcttccaggcgtcgttgaggtggtgttccaacgccatctggatgcggttgttgtggttatcgatgttgccgtcgttgggctcgccgaggaaggttgaatgggacatacccgtgttggcgacgatgccgcggtcgaaggtggagctgtggcgcacgaattcgctttctacgagcaggtgggtgtcggggtcgagttgccaactgaatgaaggcgcgacgaacacccgtttgctgtcgacgtgatcgcgaaagctgtggttgtcttccaccgccaggttgacccgggacaatacgcgcccttcgctgtccagcggtgtattcacatccaaagcggtgcggtagcggtcccaactaccggcgctggtctgcagggtggtgaaggcctcgggctggggtttcttggtgacgatattcaccgtgccgccagggtcgccacgcccatacaggctggcggcggggcccttgagcacttcaatgcgttcgatattggcggtatcgggtgtgctcgggtaaccgcggttggcgctgaaaccatcctggtagaactcggacgtggtgaagccgcgcacgctgtattcgtagagggtcaggccgccgaagttgttctgcttggacacgccgccggcaaattccagtgcgcgttccacactggtgctgcccaggtccttgagcactgtggcgggaatcacgctgatcgattgcgggatatcgcgcagggcggtgtcggtcttggtggcactggctgtgcgagtggcgcggtaacctgtgaccggcccgatggcggattcataggcctcggaggtcacgctgatggtgtccagttccagggtattttcttcggcgtaggcggggtcgagcagcaaacccagggccaggccggccgagggcacaaacttgcgaggcggcatgatagaacgttccaatgacgatattgaaacaatataacatgactaatgagagtgaatgctgtgaaacctgcccatcaagcgccctcgaatgagcgcctgatgtgcgtaggctattgttcttctttcaccggcgccgttgccggcggtgggcgcaggccgatttccgccgagagcttgatctccttgccgttgcgcatgacctggatcgccaccttgtcggtcggcttgatccgtgccacctggttcatcgacttgcggccgtcaccggccggggccccgtcgatacttaggatcacatcgcccagttgcaggccggccttctgcgccgggccgtcgcggaagatcccggcaaccacgatgcccgggcgcccggtcaagccgaacgactcggccagttccttggtcagtggctgcacttcaatgcccagccagccacgaatcacctggccgtgttcgatgatcgacttcatcacttccatcgccagcttcaccgggatcgcgaaaccaatgccctgtgagccgccggacttggaaaaaatcgcggtattgatgcccgtcaggttgccattggcatctaccagcgctccgccggagttgcccgggttgatggccgcgtcggtctggatgaagtcttcgtagctgttaaggcccaactggttacgcccagtggcgctgatgatgcccatggtgaccgtctggccaacgccgaacgggttgccaatggccagtgccacatcacccacgcgcaaaccgtcggagcgaccgagggtaatggacggcaggttcttcaaatcgatcttcagtaccgcaaggtcggtttccgggtcactgcccaccacgcgggccaaggtctcgcgaccgtcacgcagggccaccacgatctggtcggcgccgctggtcacgtggttattggtgaggatgtagccttcggggctcatgatcaccccggaacccaggctggactccatgcggcgttgcttggggccgttgtcaccgaaatagcggcggaactgcgggtcttcgaacaacggatgcgcgggtttgttgatgaccttggtggtgtaaaggttaaccaccgcaggtgctgcaatggtgaccgcgtcggcataggtcaccgggccttggaccaccgtgctggtctgcggggcctgttgcaggttcacatccagggtaggcaggcccacccattggggataacgctggataatcagcatcgcgatcagcacgccagccaacaatggccatccaaaaaaacgcagtgccttgagcatcaagtaagtcctgacaggttgcagggggcggaagagcgcccataatgtcgcgcattatacgaggctgcgaggcctgcgaacgggatatttaggagtcttttatggccgtcccccttaccaccctcgtcgaggaagcggaccgctacctcggcagtgcaaaaattgctgattactgccccaacggcctgcaggtcgaggggcgcccgcaggtgatgcgcatcgtcagcggcgtgaccgccagccaagcattgctggacgcagccgtcgaagccaaggccgatctggtgctggtgcaccatggctatttctggaagggcgagaacccgtgcatcaccggcatgaagcagcgccgcctgaagaccctgctcaagcatgacatcagcctgttggcctaccatttgcctttggacctgcacgccgatgtcggcaacaacgtgcaactggcgcgtcacttggacatcaccgtcgaaggcccgctggacccgagtaaccccaagatcgtcggcctggttggctccctggctgagcctctatcgccccgggacttcgctcgccgcgtgcaggacgtgatgggccgcgagccactgctgatcgaaggcagccagatgatccgtcgcgtcggttggtgcaccgggggtggccagggctatatcgaccaggcaattgccgcgggtgtcgacctctacctgagcggtgaggcgtccgaacagaccttccacagcgcacgggaaaacgacatcagcttcatcgccgccggccatcacgccactgagcgctacggcgtccaggcgttgggcgactacctggcgcgacgctttgccctggagcatctgttcatcgattgtccgaacccgatctgaatgtgggagggggcttgtcccctcccacactagcccccccatttcaggccaaactcggcggcatattcatataccgtttcgatctagttggcgccctgaatagaagcaggtgctgtgctagcatgcctcgctcgaacacggcccgctggccgtccataagatcgtttttccgtgagtaaccatggtcgacaaactgacgcatctgaaacagctggaggcggaaagcatccacatcatccgcgaggtcgccgccgagttcgacaacccggtgatgctctactcgatcggtaaagactccgccgtgatgctgcatctggcacgcaaggccttcttcccaggcaagctgccgttcccggtgatgcacgtcgacacccgctggaaattccaggagatgtacaagttccgcgaccgcatggttgaagagctgggcctggacctgatcacccacgtcaatcccgatggcgtggcgcagggcatcaacccgttcacccacggcagcgccaagcacaccgacatcatgaagaccgagggcctcaagcaggccctggacaagcatggtttcgacgcagcgttcggcggcgcccgtcgcgatgaagagaagtcccgtgccaaagagcgcgtgtactcgttccgcgacagcaagcaccgctgggacccgaagaaccagcgcccggagctgtggaacgtctacaacggcaacgtcaacaagggcgagtcgatccgcgtgttcccgctgtccaactggaccgagctggacatctggcagtacatctacctggaaggcatcccgatcgtgccgctgtacttcgccgccgagcgcgacgtgatcgaaaagaacggcacgttgatcatgatcgacgacgaccgcatcctcgagcacctgtccgacgaagacaaagcccgcatcgtcaaaaagaaagtccgtttccgcacccttggctgctacccgttgacgggtgcggtggagtccgaagccgaaacgctgacggacatcattcaggaaatgctcctgacgcgaacttccgagcgccagggccggatcatcgatcacgatggcgccggctccatggaagacaaaaaacgtcagggttatttctaaggggttgtcatgtcgcacgtatctgatttgatcagcgaggacatcctcgcctacctggcccagcacgagcgcaaggaaatgttgcgcttcctgacctgcggcaacgtcgatgacggcaagagcaccctgatcgggcgcctgctgcacgactccaagatgatctacgaagatcacctggaagccatcacccgcgattcgaagaaatccggcaccacgggcgacgatatcgacctggccttgctggtcgacggcctgcaggcggagcgtgagcagggcatcaccatcgatgttgcctatcgctacttctctaccgccaagcgcaagttcatcatcgccgacacccccggccatgagcagtacacccgcaacatggccactggcgcgtctacctgcgacctggcgatcatcctgatcgacgcccgttacggcgtgcagacccagacccgtcgtcacagcttcatcgcctcgttgctggggatcaaacacatcgtggtggccgtcaacaagatggacatcaatggctttgatcaaagcgtcttcgagtcgatcaaggccgattacctgaagttcgccgaaggtattgcgttcaagccgagcaccttggcctttgtaccgatgtcggcgctcaagggcgacaacgtggtgaacaagagcgagcgttcgccctggtacaccggccagtcgctaatggagatccttgagaccgtcgagatcgccaacgaccgcaactacaccgacctgcgtttcccggtgcagtacgtcaaccgcccgaacctgaatttccgtggtttcgccggcaccctggccagcggcatcgtgcacaagggcgacgaagtggtggtgctgccgtcgggcaagagcagccgggtcaaatccattgtcaccttcgaaggtgagctggaaaacgctggcccaggccaggccgtgaccttgaccatggaagacgagatcgacatctcccgtggcgacctgctggtgcatgccgataacgtgccgcaagtgaccgacgccttcgacgctatgctggtgtggatggccgaagagccgatgctgccgggcaagaaatacgatatcaagcgcgccaccagctacgtgccgggctccatcaccagtatcgtgcaccgcgtggatgtgaacaccctggccgagggcccggcgagttcgctgcaactcaacgaaatcggtcgggtcaaggtcagcctcgacgccgccatcgcgttggatggctatgacagcaatcgcaccaccggcgcctttatcgtcatcgaccgtttgaccaacggcaccgtggctgcgggcatgatcatcgcgccgccggtcaatcatggcggttctgcgcagcacggcagtctcgcgcacgtcgccaccgaagaacgcgccctgcgtttcggccagcagccggccacggtgttgttcagcgggctgtccggcgctggcaaaagcaccttggcctacgcggttgagcgcaagctgttcgatatggggcgtgcagtgtttgtactggacggccagaacctgcgtcacgacctgaacaagggcttgcctcaggaccgtgccgggcgtaccgagaactggcgccgtgcagctcacgtagcacgccagttcaacgaggctggcttgctgaccctggccgcattcgtcgcgccggatgccgaaggccgtgagcaggcgaaggcgctgatcggcgctgaccgtctgctgacggtctatgtgcaggcctcgccgctggtgtgcgccgagcgtgatccgcaaggtttgtacgcggcgggtggggataacatcccgggtgagtctttcccgtacgacgtgccgttgaacgccgacctggtgctcgatacccaggccttgtcgctggaagacagtgtcaagcaagtgctggagttgttgcgccagcgcggcgcgatctaagggttgactacaaaaaagccgccaccgatgactcggtggcgggcttttttacatcttcaagatcgagcgcggtcaaatgtgggagggggcttgcccccgatagcggcgggtcagctacggctgcatcaactgatactccctcatcgggggcaagccccctcccacaggttgatcatcgcttgcttgggaattcggtgtgaagctgatccagtaacgcatccttgtcttcccacagttggttgatccagccctggaacgccaaccgatactctccatcctgctcataattcttgccaatgaattcggccggaatctgcacctcttcaaactgcaccactacgtccttcacattcccgcacagcaaatcccaataccctgggcgtccgccagggtagtgaatggtcacattcaccagtgacttcaactgctcccccatggcatccagcacaaacgcaatgccgccggccttgggcttgagcaaatagcgaaatggggagttttgttgcgcatgcttgcccggcgtaaaccgcgtgccctcggcgaagttgaaaatgcccaccgggttgtcgcgaaacttcgcacaggttttgcgggtggtcgccaagtccttgcctttcttttccgggtgcttctccaagtaagccttgctgtagcgcttcataaagggaaagcccagtgcccaccacgccaggccgatcaccggcacccagatcaattcctgcttgaggaagaatttcaacgggcgaatacgtcgattgagcacgtattgcagcaccatgatgtcgacccagctctggtggttgctggtcaccagataggagtgctgatagtccaacccctcgagaccagtcaggtgccagcgcgtgcgccgtaccaggttcatccagcccttgttgttggtcacccaggcttcatgggtatggttcatcagccactcgctgaagcgcttggcgaacggcaacgccttgaacagcgcgacgataaacaggaacgagcacagcaggatcgtgttcagtgccagcaacagcgaagcgatcaccccgcgcacggcggcaggtagaaaatccagcatttagatatccataggtcggttagcggcttggatcgccgtcagggcgatggtgtacacgatgtcatcaacctgggcgccacgcggcagatcgttcaccggcttgcgcaggccctggagcattggccccaggcttacgcaatcggcgctgcgttgtacggctttgtaggtggtgttgccggtgttgaggtccgggaacacaaataccgtggccttgcccgcgacctggctgttgggggccagttgccgggcgacgttttcgttggcggcggcgtcgtattgcagcgggccgtcgatcagcagcgaactttgctgctcgtgggcgagcagggtggcttcgcggactttttccacttcctcgccgctggccgaatcaccgctggaatagctgatcattgccacccgtggcgtgatgccgaacgcggcggcggaatcggcgctttgcaaggcgatttccgccagttccacggcgcttgggtgtgggttcatcacacagtcgccgtacaccagcacctgctcggggaacagcatgaagaacaccgacgataccagggtgcatccgggcgcggtcttgatcagttgcagggcagggcgaatggtattggcggtggagtgaacaaccccggagaccaggccgtccacttcgtccagggcgagcatcatggtggcgatcaccacggtatcttccagctgttgctcggccatgggcgcgttgaggctcttggttttgcgcaaggcaaccatcggctcgacatagcgctgacgaatcaggtccgggtcgagaatctccaggccctcaggcagctcgataccctgggcgcgggcgactgcttctacatcctccggcttggccagcaggacgcaacgggcaatgccccgggcctgacagatggcggcggcttgcacggtcagcggctcgctgccttcgggcaacacgatgcgcttgttggcggcctgggcgcgttggatcaactggtagcggaacacggccggcgacaggcgcatctcccgtggcgtaccgcaacgctggtgcagccagcgcgcatcgaggtggctggcgacgaagtcagtgatgatctccgcacgctcgcggtcatcgatggggatttccttgttgaggctattgagctggttggcagtgtcataggagccggtgctcaccgacagcactggcagcccggcctggaaggcgccgcggcacaggtccatgatgcgtgggtcgggcagcgtgtcgctggtcagcagcaggccggccagcggcacgccgttgatcgcggccaagctgacggcgaggatgatgtcgtcgcgatcccccggggttaccaccagcacgccgggcttgagcaactccacggtgttgcgcatggtgcgcgcgcagatgatgatcttggtcatgcgccggctttcgtagtcgccggcgttgaggatctgcgcgcccatcaggtcggccacgtcacgggtgcgcggggcgttgagctcgggctggtaggggatgcagccgagcaggcgaaagtcaccgctgcgcaacagcggcgagtgctctttcaggcgcgccgagaaagcctccatgctttcgtcggtgcgtaccttgttgaggatcacgcccagcactttcgggtctttcgggccgccgaacaattgcgcctgcaattccacccggccagaaagttcggtgagtacctcgttttctggtgccgagaccaggatcacttcggcatccaggctcttggccaggtgcaggttgacccgtgcggcgtagctggcgctgcgggtcggcaccataccttcgacgatcagcacgtcctttcccacggcggcctgctggtagagggtgatgatttcttcgagcagctcatcgagctggccgtcaccgagcatgcgttctacgtgggcaaggcccaagggttggggcggtttgagcccgtgggtgcgtgccaccagttctgtggagcgctccgggccggtatcgcccgggtgtggctgggcaatcggtttgaaaaagccgactttaaggccggcccgttccagggtgcgcaccagcccaaggctgatggaggtcaggcccacaccaaaatcggtgggcgcgataaaaaaagtctgcatgcggattctctggaggtgcatggcttgggtggcgctctatgtttgagtgcctaccgcggatcaggcgccaaggttagcgttattcgcgcgcttgcgcacaccagccgcacgcaaagggttggcctattttttcaaggcgttgcgcagggtcgagtacccaggcgcgtgactgccatggcggctggtggcgcaagtgctgggtgtggccgcaggacagttcggcgacccaatgccggtcgtcgtcctgatggaaaccggtgatgagggatgccgttgatcggccccgtccgtccgggttctgttcgctttcgggcaaatccttgtttagacttgtccgttcttcattcttatgcaaaaggtctcgccccatgacgatcgccgctaacaaggctgtctccatcgactataccctgaccaacgacgctggtgaggtcatcgacagctcagccggcggcgcgccgctggtctacctgcaaggcgcaggtaacatcatccccggcctggaaaaggccctggaaggcaagagcgtcggtgacgagctgactgtcgccgtagaacctgaagatgcctacggcgaatactccgccgagctggtcagcaccctgagccgcagcatgttcgaaggcgttgatgagctggaagtgggcatgcagttccacgcttccgcgccggacggccaaatgcagatcgtcaccatccgtgacctggacggcgacgacgtgactgtcgacggtaaccaccctctggcaggccagcgcctgaactttcaagtgaagatcgttgccattcgcgacgcttcccaggaagaagtagctcacggccacgtccacggtgaaggcggtcatcaccattgattgtggtttgatcaataggtagcaaaaacgccccgactggttcggggcgattttttttgcgttttaatgtgggagggggcttgctcccgatagcggtgtatcagtaccagatattctgactgacacaccgctatcgggagcaagccccctcccacaagggaagttgtgatgaatctttgggcaaacaaaaatgccccggacctttcggtacggggcatttcttaactgtttcgcaaccagggctgcgtggcagttgttaccacttaggcagcagcaggaacgctcagagccttgatgtggccattcaggcggctcttatgacgagcggccttgttcttgtggatgatgcctttatcggccatacggtcgataactggcacggccagaacgtaagcagcttgggctttttcagcgtctttggtgtcgatggctttaactacattcttgatgtaggtacgaaccatggaacgcaggctggcgttgtggctgcgacgcttctcagcctgttttgcacgttttttggcggaaggtgtgttggccaccgtcgagctcctcgaaagactttttaggaaatagcaaacaaaataggccgcgaatcatgccgatgacttgatgggttgtcaagggcggctgatgcgaactgctgagtggtcgatctgaagaggcgggtgatttatttccggcgcttgacctgtaaactcgcgagctttggctctgtgctgttgcaggcgcgcagtatcgcataagtgggcgctttgttcgcctgctctttatctataggcgcaaactctttcaatgaatctgctcaaatcgttggctgccgtcagctctatcaccatgatctcccgggttttagggtttgtgcgtgacaccctgctggcgcgcatctttggcgccagcatggccacggatgctttctttattgcctttaaactccccaacctgttgcggcggatcttcgccgagggtgcgttttcccaggccttcgtgccgatcctggccgaatacaagacccagcagggcgaggaggcgacccgtacctttattgcctacgtctcgggcctgctgaccctggtgctgatgctggtgacgttgatcggcatgctcgccgcaccctgggtgatctgggccacagccccgggatttgccaatactccggaaaaattcgcactgaccactgatctgttgcgagtgacctttccttatatattgctgatctcactgtcatccctggccggggcgatcctcaatacgtggaaccgtttctcggtgcccgccttcgtgccgaccctgcttaacgtcagcatgattatttttgcgctgttcctgacgccgtattttgatccgccggtcatggccctgggctgggcggtcctggccggaggcctggcgcagctgctgtaccagctgccgcacttgaagaaaatcggcatgctcgtgttgccgcgcctgaatctcaaggacaccggtgtctggcgcgtgatgcgcaatatgctgccggcgatcctcggggtgtcggtgagccagatttcgctgatcatcaacaccgcgttcgcttcgctgctggtctcgggctcggtgtcgtggatgtattacgctgatcgcctgatggagttgccgtccggcgtgcttggcgtggcgttgggcacgatcctgctgccgaccctggcgcgcacctacgccagcaaggaccgccaggagtattcgcgaatcctcgattggggcctgcgcctgtgcttcctgctggtattgccatgcgccctggccctggggatcctcgccgaaccgctcacggtctcgctgtttcaatacggagaattcgatgcgcatgacgccttgatgacccagcacgcgctggttgcctactccgtcggcctgctcggcattattgtgatcaaggtgctggcacctggtttttacgcgcagcaaaacatccgcaccccggtgaaaatcgcaattttcacgctgatcgtcacgcaactgctcaacctggtctttatcgggcctttggcccatgccgggctggcgttggcgatcagtgccggcgcctgcatcaatgccggcctgctgttttaccaactgcgcaaacagcagatgtaccagccacagccgggttggggagtgttctccctcaagttgctcgtggcagtcgccgcgatgtccgccgtgctcattggcctgatgcacttaatgccggcctggggccatggcgatatgctggagcgcttcatgcgcctggggatattggtggttgcaggcgcggcggtgtacttcggcatgttgctgttgcaaggtttccgcctgcggcatttcaatcgcaagtcgctgggatagagagtttgccgcgataaaacgggtgttttatcgaatcgacccatttggcctgcgctgttgcctgtcgtccggggctgggtgtggttataatcgaccactttatgagcaagaagcgcgttatgcagctggttcgaggtcttcacaacctgcgccccgagcatcggggctgcgtcgccactattggcaactttgacggtgttcaccgtggtcaccaggctatcctggcccggctacgcgagcgtgcggtcgagttgggcgtgcccagctgcgtggtgattttcgagccacaaccgcgggagttctttaccccggaaacggcgccggcccgtctgacgcgcctgcgcgacaagctgcaactgctggccgaagagggtgtggaccgcgtcctttgcctggctttcaaccagcgcttgcgtagcctcagcgccaccgagttcgttgaccgtatcctggtggacggcctgggggtgcaacacctggaggtcggcgacgacttccgtttcgggtgtgaccgggtcggggatttcgatttcctgcaacatgccggcgtcaatcaggggtttaccgtcgaagccgcgcaaaccgtcgaactggacggcctgcgtgtgagcagcacccaggtgcgtaacgccctggctgctgccgacttcggcctggccgagcgtttgctcggtcgcccgttccgcattgccgggcgggtattgcacggccagaagctggcgcgccaattgggcacgccaactgccaacgtgcaactaaagcgccgtcgtgtacccttgaccggggtttacctggtgagcgtcgatatcgacggccaatcgtggccgggagtcgccaatataggcgtcaggcccacggttgcaggtgatggcaaggcccacctggaagttcaccttttggattttgccggtgatttatacgaccggcgtttgacggtggttttccaccagaagctgcgtgaagagcagcgtttcgcctccctggaggcgttgaaaacggcgatcaatgcggatgtcgccgccgcccgtgcactagccgcacctagcgcccatcgctaaccgaagagccttaaatgaccgactataaagccacgttaaaccttccggacaccgccttcccaatgaaggccggcctgccacagcgcgaaccgcagatcctgcagcgctgggacagtattggcctgtacggaaagttgcgcgaaattggcaaggatcgtccgaaattcgtcctgcacgacggccctccttacgccaacggcacgattcacatcggtcatgcgctgaacaagattctcaaggacatgatcatccgctcgaagaccctttcgggcttcgacgcgccgtatgtcccgggctgggactgccacggcctgccgatcgaacacaaagtcgaagtgacctacggcaagaacctgggcgcggataaaacccgcgagctgtgccgtgcctacgccaccgagcagatcgaagggcagaagtccgaattcatccgcctgggcgtgctgggtgagtgggacaacccgtacaagaccatgaatttcaagaacgaggccggtgaaatccgtgccttggccgaaatcgtcaaaggcggtttcgtgttcaagggcctcaagcccgtgaactggtgcttcgattgcggttcggccctggccgaagcggaagtcgagtacgaagacaagaagtcctcgaccatcgacgtggcgttcccgattgccgacgacgccaagctggccgaggcctttggcctggcgagcctgagcaaaccggctgccatcgtgatctggaccaccaccccgtggaccatcccggccaaccaggcgctgaacgtgcacccggaattcatctacgccctggtggacgtcggtgatcgcctgctggtgctggccgaggaaatggtcgaatcgtgcctggcgcgctacgagctgcaaggctcggtgatcgccaccaccaccggttccgcgctggaactgatcaacttccgtcatccgttctatgaccgtctgtcgccggtgtacctggcggactacgtagaactgggcgccggcaccggcattgttcactccgcgccagcctatggcgtagacgacttcgtgacctgcaaagcctatggcatggtcaacgacgacatcttgaacccggtgcagagcaatggtgtgtacgtgccgtccctggaattcttcggcggccagttcatcttcaaggccaaccagccgatcatcgacaagctgtcggaagttggcgcgctgctgcacaccgaaaccatcaagcacagctacatgcactgctggcgccacaagaccccgctgatctaccgcgccaccgcgcagtggtttatcggcatggataaagagccggtccagggccagaccctgcgcaaacgtgcgatcaaggcgatcgaagacacccgattcgtcccggcctggggccaggcgcgcctgcactcgatgatcgccaaccgtccggactggtgcatctcccgccagcgcaactggggcgtgccgatcccgttcttcctgaacaaggaaagcggcgagttgcacccgcgtaccgtcgaactgatggaggtcgtggcccagcgtgtcgaacaggaaggcatcgaagcctggttcaagctggacgccgccgaactgttgggcgacgaagcgccgctgtatgacaagatcagcgacaccctcgacgtgtggtttgattcgggtaccacccactggcacgtgctgcgcggctcgcaccctatgggccacgagaccggcccgcgtgctgacctttacctggaaggctcggaccaacatcgcggctggttccactcgtcgttgctgaccggatgcgccatcgacgaccacgcaccataccgtgagctgctgacccatggtttcaccgtcgacgaaaacggccgcaagatgtccaagtccctgggcaacgtgatcgcgccgcaaaaggtcaacgacaccctgggcgccgatatcatgcgtctgtgggtggcctcgaccgactattcgggcgagatggccgtctcggagcagatcctgcagcgcagcgccgatgcctaccgtcgcatccgcaataccgcacgcttcatgctgtcgaacctgaccggtttcaacccggctaccgacctcctgcccgccgaggacatgctcgccctggaccgttgggccgtggaccgcaccttgttgctgcagcgtgagctgcaggagcactacggcgagtaccgcttctggaatgtttactcgaagatccacaacttctgcgtgcaggagctgggcggtttctacctcgacatcatcaaggaccgccagtacaccaccggcgctaacagcaaggcgcgccgctcggcgcagaccgcgctgtaccacatcagcgaagcgctggtgcgctggatcgcaccgatcctggcgttcaccgccgacgagctatgggaatacctgccgggcgagcgtaacgagtccgtcatgctcaatacctggtacgaaggcctgaccgaactgccggccgacttcgaactgggccgtgagtactgggaaggcgtcatggcggtcaaggtcgcggtgaacaaggagctggaagtccagcgtgcggccaaggccgtgggcggcaacctgcaagccgaagtcaccttgtttgccgaggaaggcctgaccgccgacctcgccaagctgagcaacgaactgcgcttcgtgctgatcacctccaccgcgagcctggcacctttcgcccaggccccggcggatgccgtagctactgaagtgccgggcctcaagctcaaagtggtcaagtcggccttccccaagtgcgcccgttgctggcactgccgtgaagatgtcggtgtgaaccctgagcatccggaaatctgtggtcgttgcgtagacaacatcagcggtgctggcgaggttcgccactatgcctaactcagccagtcgttttggacgtctgggctggctcgtactgagcctgctggtcttggtcattgaccaggtcagcaaggctcatttcgagggctccctggaaatgttccagcaaatcgtggtgatcccggattacttcagctggaccctggcctacaacaccggcgccgccttcagcttcctggctgacggcggtggctggcagcgctggttgtttgccctgatcgccgtggtggtgagttcagtgctggtggtctggctcaagcgcctgggtcgcgacgacacctggctggctatcgccctggccctggtgctgggcggtgcgctgggcaacctgtatgaccgcatcgccttgggccatgtgatcgacttcatcctggtgcattggcagaaccgccattatttcccggcgttcaactttgccgatagcgctattactgtcggcgcaatcatgctggcgctggatatgttcaagagcaagaaaaccggagagaccgtcaatgactgatcaggtattggctgagcaacgcatcggccagaacacggaagtcactttgcatttcgcattgcgcctggagaatggcgacacggtcgatagcaccttcgacaaagcgccggcgactttcaaggtgggcgacggtaacctgttgccgggttttgaagccgccctgttcggcttcaaggctggcgacaagcgtaagctgcagatcctgccggaaaacgcatttggccagcccaacccgcaaaacatacagatcatcccgcgttcgcagttcgaaggcatggatctgtcggaaggcttgctggtgattttcaatgatgcggcgaataccgaactgcctggcgtggtgaaagctttcgatgacgcgcaagtgaccatcgacttcaaccacccgttggccggcaagacactgacctttgacgtcgaaatcatcaacgtcaaagcgctgtaactgaccgtacacggtctaaaatgtgggagggggcgtgctcccgatagcgatgtatcagctaagtatttgcagattgatataccgttatcgggagcaagccccctcccacctttgatctccattgtcggttgagtcggcgttaaattcgactcaatgtggctgcaagacacgaggcacagcatgcaaatcaaactcgccaacccccgtggcttctgcgccggcgtggaccgggcgatcgaaatcgtcaaccgcgccctggaagtcttcgggccgccgatttatgtgcgtcatgaagtcgtccataacaagttcgtggtcgaagacctgcgtgcacgcggcgcgatctttgtcgaagagctcgaccaggtgcccgacgacgttatcgtcatcttcagtgcccacggtgtgtcccaggcggtgcgtaccgaagcggcaggccgtggcctgaaagtgttcgatgccacttgcccgttggtgaccaaggtgcacatcgaagtggcgcgctacagccgtgacggccgcgaatgcatcctgatcggccatgccggtcacccggaggtcgaaggcaccatgggtcagtacgacgccagcaacggcggcgccatctacctggtggaagacgaaaaagatgttgccaacttgcaggtgcacaacccggatcgcctggcgttcgtgactcagactaccttgtccatggacgataccagccgtgtaatcgatgccctgcgcacacgattccccgcgattggtggcccccgcaaggacgacatctgctacgccacgcaaaaccgccaggatgcggtcaagcaactggcggatgagtgcgatgtggtgctggtggtcggcagcccgaacagctccaactccaatcgcttgcgtgagctggccgaacgcatggccacaccggcatacctgatcgatggcgccgaagacatgcagcgcagttggttcgatggtgtcgagcggattggcatcaccgcgggcgcctcggccccggaagtcctggtgcgcggcgtgatccagcagttgcaggcctggggcgccaccggtgctgatgagctggctggtcgtgaagagaacatcacgttctccatgcccaaggaactgcgggtccgctcgctgctctgacgcccgacgtactggtatagcctcggcataatgcctgctcggttttcacactgcgcaggctgatgcgcccgctgggcgccagcactacctggtacaggctctgtgcctggcttgtgtcgcacacatgcacggtgccggcacggaagcccccgccggcaaagaccggctcccccaaaccgctgaaacgcacctggttcgtgaccgggccattgcccgcgattagcacatgcccgctgtcctgtcgttccagcaataccgggttatcttcgtccaggtgaccacgcccactgatgtccagtatcacccgccaccccaggctccagtcctcgtcccgcgcgtgaatgaccaccgcctgattgcgtgcgatggcctcggtgcgtgcgtaacgcaggccagcagcgagtgattgggccacgctttgtcgctgctgtgattcaagcaaccctttgaagcctggcacggccagttgtgcaagaaagctggtcacgatcagcccaagcagcatttcaatcagggtgaaccctcgttgtgtcatgtgcgttccctccgtggacgcgagtgggtcttcaagttgcagacataggtatagccctgggctcctggcgatgaatgatggcctttatgtccaaagtatttccctttgttcctggagcagcgccgcttgaaaaccgacgctagtcttgggtcgtacagcaggtttcgcctgcttttttccggccttcgacatggatgacgacggtaatgcccgcctgcccgaaacgttttttcctgcgcgctttccagcggcgccaatccggcatgaccttgatcgaggtgctggtagcgctgctgatcctggccattggtctgatgggcactgcaatgctccagctcaatgcgctcaagtacaccgacagcgccaggatgaccagccaagccagttttatcgcctacgacctgcttgaccgcattcgcgccaacgccggtgcagactactcgtggggcagcgccgagcccgcgccgcgcagcacttcgactgccagtgtgcgtgacttggacctgcacgatttcgaggccaatatcattggtttcgctggcgaaggcgctaaagggtcggtggctttaagtgggcatgaggtcaccatcagcatcagttggcaggacgctcgggcggcaaacaggcctggagcgcgggaaaccttcaccctgaccagtcgtatcgctaatgatcagggagcgttgcaatgaatcgtcttgctcgaggtttcagcctggtggaattgttgctggcactcgccgtagggctagtgctggtgctgggtgcgagccaggtgttaatcagctcgcgactgacccatgccagccagcaggccgcaatggtgctgcaggatgatgcgcggtttgtcctgagcaagattacccaggacatacgccaggcaggcatgctggggtgcctggccacggccgtcatcgacaacgcgcctgccgcctttgatcggccgataagctgggaggcgtcggcgagtacaaagtcactgacattggttacggcgagcgtcggtgagggtgctggcaagcccgattggacagtgctgtccgactgcaaggaggtggcccaggcttatgccggggcaccgcctgccgccgcacctggccagatccgctttggcatacgccagcttacctacacctacgaaacaggccagttgaagatcagtacgccggcaacacctgcgaaagccgtactgatggataacgtgcgggcattcgacatcagctttggcatggcggcccaaccggcatcaacggttgtggtgcgttacgacagccacccggttgccgcatcgttgatacgcagcgtgcgcatccatatgacactgcaagacccgtctggacgggtgaaggatcagagctacagcgtcgtggccgcgctgcgaaatcggctgggttaggcgtgatgatcatgcttggcgggcttcatgtgcggcaggccgggatggtgttgctgatctgtctggtattcctgctgctgttatcgctggtggggttgtcatccatgcagggggcggtatcccagcaaaaagtcgcaactagcctgtggcatcgcaatcaatcatttcaacatgccgaaagcggcctgaggttgggcgagtgggcggtacagagggcaggcggggcattgcccatctgccactcggtcatcacctgtgcgccgcccgttgaagctttttcgttggtgcgcgccggccccaaccctgtatccgcggtcttctgggttgcgctgaagggtggattctatggcgttcaagcgctgggtatgggggccgatgtggtccatctaccagcttatgccccagcggcactgttccgggtaaccgcggtcgggctcgcaggccaatcacgcacggtgctggagacggtctacgcacgtgtggaggagggcggcaacgtcaggtttcgacgggtcttatggcggcaacttcaatagggagcaatagaatgggcatggatagccggggctttagcctgatcgagttactgatcgtggtggcgatcatcgcgttgctggctggggtcacctatcccggatatatcggacagataaaaaaagtatatcgagcgcaaatcgtcgcgttgttgagcgagcaggcccagcacttggagcgtttttatacgaagaacggcacttttattgacgcaagcagcgtcagtgcgggcaatgatcattatagaatcagtgtcgtgttaaacccccaggattttgacctgctcgctacgcctgttgtggattcggtgatggcgggtgacgcgtgtgcagctttcggcttgaccagcaccggtatgcgaagtaatccgggagcggcgcctgatatgtcgcgcaagctctgctgggggcaatgatgagcgtgcttgaagagtgggcgccgggcgcgtccttccctgtttatcggctggatcaaataatggctaagcaacagcaagtggtgattgtcggcggcggagtcatcggtctgttgacggcgtacaacctcgccagggaggggcagacggtcatactgctggagcgggcggggcttgggcaggagtcttcgtgggcgggtggcgggattgtttcgccattgtatccatggcgctatagcccggcggtcaccgccttggcccattggtcccaggatttttacccgcaattggcgcagcgcttgtttgccgctaccggcgtggatcccgaggtgcataccacgggcctgtactggcttgacctggatgatgaaggccaagcattggcctgggctgcgcgtgaagaacggccattaagcaaggtggatgtgtcggcggcccatgatgcagtgccggtattgggaggcggctattcccgggcgatctacatggccgacgtggccaatgtacgcaacccgcgcctggtcaaatccctgagggctgcgctgctggcattgccgggtgtgacaatacaagagcattgcgaagtacaaggatttgtccgcgagggtgacagcgtggtgggcgttaacaccgctgcagggcaggttccaggtgatcaggtggtgctcgctgccggggcctggagtgggcaattgctgggcacgttgggcttggcattacccgtagagccggtcaaaggtcagatgattctgtacaaatgtgcgtctgactttttatccagcatggtcctggccaaggggcggtatgcgatcccacgacgtgatgggcacatcctgatcggaagcacattggagcatgaggggttcaacaagacgccgaccgaaactgcgttggaaagcctcaaggcctctgcggtagagctgattccggccttggcggccgccgaggtggtcgggcattgggcagggttgcggcctggctcgccggagggtatcccgtatatcggtgaggttcctgggttcaaggggttgtggctcaattgcgggcattaccgcaatggcctggtgctagcgccggcctcctgccagttattcgctgacttgctgttggcgcgggccccgatcatcgatcccgcgccttattcgcccgccggtcgcctcaacgctggatagacttcggcccttgttccaagtgtgcctgggtgcaataccacgcctggcttgaactcagtgcgcgatcctgcggcagatgcacgccgcagtgggcgcaacgcaccatcagcgctgcattcggctcagcaggccgttgctggcgcgctgtagggtttttgaatttgcgccagaaccataccgcggcagcaatgacggcaatccagaacagtagacgaagcataatgggcagtttctcggcaaggaatgcgccagtttagccaaggtggccacgggcgcacagcgcaataaatactcgctcataaaaaagggagctcctcagagctcccttttacgttgcgtcgaacaatcagtcgaacacaccgaaggtcatgtagctgaaccacgaacggtcttcgttgttgccaagggcctgcggctcctcttcttcgatgacgtcgccgttctcgtcgtgaggcttgaggtccgaaggaatggcgtccttggcatcctggtactgcttgatcacgtcctgattggcgcgggtttcgcccggcggcaacggtgggcgggattcgatcaggcccagggtgtatttgctcagccaggaacggttgtccgcttcggccacctgaggcacgaactggccgtctttcaggcttgggtggtcagggtagttgagtttcaaggtttccaggctagtggtcgccagtgtatcgagatgcagacgctggtaagcctcggtcatgactgccaggccgtcacccacggagggggtttcctggaagttctccactacatagcggccacggttggcggctgcgacgtacgcctggcgggtcaggtagtagtgggctacgtggatctcgtaggacgccagcaggttgcgcaggtagatcatgcgctgcttggcgtccggcgcgtagcggctgttcgggtagcggctggtcagctgggcgaactcattgtaggagtcgcgggcagcacccgggtcgcgcttggtcatgtccagcggcaggaaacgcgccagcaggccaacgtcctggtcgaacgaggtcaggcccttcatgtagtaggcgtagtccacgttcgggtgctgcgggtgcaggcggataaaacgctcggcagcggacttggcagcttccggctcggcgttcttgtagttggcgtagatcagctcaagctgggcctggtcggcatagcgcccgaacgggtaacgcgactccaaggccttcagctttgctgtggcgctggtgaagctattattgtccagatctgtctgagcttgctggtacagctcgacttcgctcaggttttcgtcgacgacgtcctttgttgacgagcaagcagcagtcatggcgaggatggcgatcagcagcaggtgtttcacttgcatggcggcttgcgtccctatgacggccgctgtcttgggcggggccgtcctgttatgatgagcgccccgttgaaagcctcggggcaaaagacgccgtatttaaccacaagcgcgcagccgaaaccaaaggctgtgccacgcctagtctgagcatgtccgataaaattgaacttcgcgcagaggtgccgtccgaattgggcggccaacgcctcgatcaagtcgccgcacaattattcgctgagcactcgcgctcgcgcctttccgcctggatcaaagacggccgcctgactgtggatggagcggttatccgcccgcgagacatagtccatggcggtgcgattcttgagctgactgccgagcaggaagcccagggagaatgggtcgcccaggacatcgagctggatatcgtctatgaagacgacgacatcctggtcatcaacaaacccgcgggcctggtggttcacccggccgccgggcacgctgatggcaccttgctcaatgctctgttgcaccacgtgccggacattatcaatgtcccgcgctgcggcatcgtgcaccgcctggacaaggacaccaccggtctgatggtggtggccaagaccatccaggcgcagacgcagcttgttactcaattgcagagccgcagcgtcagtcgtatctacgagtgcatcgtgatcggcgtggtggtggccggtggcaagatcaacgcccccattggtcgccacggccagcagcgccagcgtatggcggtgatggaaggcggcaagcaggccgtcagccactaccgtgtgctggagcgtttccgttcccacacccatgtgcgggtcaagctggaaaccgggcgtacccaccagattcgcgtgcacatggcgcatatcaacttcccgttggtcggagatcctgcctacggcggtcgtttccgaattccgccggcggcgagccaaaccatggttgaatcgctgaaatccttcccgcgtcaggcactgcatgcccgtttcctggagctggatcatccgacgagcggtaagcgaatgagctgggaatcgccgctgccagacgatctggtctggttgctgtcgctgctcaagcaggatcgcgaggcgtttgtcggatgaatgactggctgattcctgactggcccgcgccggccggggtgaaagcctgcgtcaccacccgagcgggcggcgtcagtctggcgccgttcgacagccttaacctgggtgatcacgttgaggacagcctggaggccgtccttgaaaatcgccgccgtctgaccgacgcgttcaatattcagcctgcctggttgcgccaggtccacggtaccaacgtggttgaggctgatccgggccgtactgtcgaggcagatggcagttggaccagcacccctggcatcgcctgcacatccatgaccgccgattgcctgcctgcgctgttctgtaatcgggcgggcacccgggttgccgcagcccatgccggttggcgtggcttagcggctggcgtgcttgaggccgcgttcgaaagcctggataccgctcccgaagacgtcttggtctggctcggtcctgccattggcccgcaagcctttgaggtcggcctggaagtgcgtgaggcgttcatgcagcaactgccggccaccgctgaagcctttgttcccagccacaaccccggcaagttcatggctgacatctaccagctggcgcgcctgcgtctggcagtacgcggtgtcaccgccgtgtatggtggcggtttatgcaccgtgaccgacccgcgcttcttttcttatcgccgcagcccgcgtacgggccgatttgcctcccttatctggcttgaacgctagactgtcctgatctgtatcaaccatccgccgcttgaaacccccagaatccaccccatctataagggtatctggcaggtttcttcattcaggatgtgtttgttcatagctccggcctgctcaaaaggaaggtgactaatgcgtattgatcgtttaaccagcaaattgcagttggccttatcggactcccaatccctggcggtcggcctcgaccatccggcgattgagcctgcgcacctgatgcaggcgctcctggaacagcaaggtggttccatcaagcccttgctgatgcaggtgggctttgacgtcaacagcctgcgcaaggagttgagcaaagagctcgaccaactgccgaaaatccagaaccctaccggcgacgtgaacatgtcccaggatctggcgcgcctgctcaaccaggccgaccgcctggcccagcagaaaggtgaccagttcatctccagcgaactggtgctgctcgccgccatggacgacaacagtaagctcggcaaattgttgctgggccagggcgtgagcaagaaagccctggaaaacgccatcaacaacctgcgtgggggcgaggcggtgaacgaccccaaccatgaggagtcgcgccaggccctggacaaatacaccgtcgacctgaccaagcgcgccgaagaaggcaagctcgatccggtgatcggtcgtgacgacgaaatccgccgcactatccaggttctgcaacgccgcaccaagaacaacccggtgctgatcggtgagcctggcgtgggtaaaactgcgattgccgagggcctggcccagcgcatcattaatggtgaagtgccggacggcctgaaaggcaagcgcctgttgtccctggacatgggctcgctgatcgccggcgccaagttccgtggtgagttcgaagagcgcctgaaatcgttgcttaatgaattgtcgaagcaggaagggcagatcattctgtttatcgacgaattgcacaccatggtcggcgccggtaaaggcgaaggttccatggacgccggcaacatgctcaaaccagccttggcgcggggcgaactgcactgcgtcggtgcgaccacgctcaacgaataccgccagtacatcgaaaaggacgccgcgctggagcgtcgcttccagaaagtcctggtggaagagccaagcgaagaggacaccattgccatcctgcgtggcctgaaagagcgctatgaggtccaccataaggtggcgatcaccgacggcgcgatcattgcggcggccaagttgagccatcgctatatcactgatcgtcagttgccggacaaggctatcgacctgatcgacgaggccgccagccgtatccgcatggagatcgactccaagccggaagtactcgaccgcctggatcggcgcctgattcaactgaaggtcgaatcccaggcgttgaagaaagaagaggacgaggcggctaagaagcgcctggaaaaactccaggaagaaatcgtccgcctggagcgtgagtattcggacctcgaagaaatctggacctcggaaaaagccgaagtacagggttcggcgcagatccagcaaaagatcgagcagtcccgccaggaactggaagcggcgcgccgcaaaggcgacctgaaccgcatggccgagttgcagtacggggtgatcccggacctggagcgcagcctgcaaatggtcgaccagcatggcaagcctgagaaccagttgctgcgcagcaaagtgaccgaggaagaaattgccgaagtggtctccaagtggaccggtattccggtgtcgaaaatgctcgaaggcgagcgcgacaagctgctgaagatggaaagcctgttgcatcagcgcgtcatcggccaggaagaggccgtggtcgcggtgtccaatgctgtacgacgttcccgggctggtttgtccgacccgaaccgcccgagcggctcgttcatgttcctcggcccgaccggtgtgggtaagaccgagttgtgcaaagccctggccgagttcctctttgatactgaagaggccatggtacggatcgatatgtccgaattcatggagaagcactcggtggcccgcctgatcggcgcaccaccaggctacgtgggctacgaggagggcggttacctgaccgaagccgtgcggcgtaagccttactcggtgatcctgctggacgaggtcgagaaggcccacccggacgtgttcaacatcttgctgcaggtactggaagatggtcgtctgaccgacagtcacgggcgtaccgtggacttccgtaatacggtgatcgtgatgacctccaacctgggctcgacccagatccaggagctggtgggggaccgtgaagcccagcgtgctgcggtcatggatgcgctgacctcgcacttccgtccggagtttatcaaccgggtggatgaggtggtgatcttcgagcctttggcgcgggatcagattgcgggtatcaccgagatccaactgggtcgcctgcgcagccgcctggctgaacgcgagctggacctggagctgagcagcgaggcgttggacaagctgatcgcggtcgggtacgacccggtgtatggcgcacggcctctgaaacgtgcgatccagcgctggatcgagaacccgctggcgcaactgatcctgtcgggcagctttatgccgggaacccgcgtcacggccacggtgaaggacgacgaaatcgtcttccattaaggcctgcatctggcgtaataagaagaggccccgcattgcggggccttttttttcgctagggcgttgaactgtaaggcaaaggcttgtaaagtgcgccccgcagcaacgtcagcccacgggtttcttctccccaagaagaaatcagaaagaagcgcaaatcattgtcttaaaagcaatttaaggggttgacaggggcttttaagattgtagaatagcgcgcctcagagacgctaacgtagcgatacggacagggtcgaagagaaggttacacagcagtaaatttgaaatatgtagttccgtgatagctcagtcggtagagcaaatgactgttaatcattgggtcccaggttcgagtcctggtcacggagccaatttcaaaccggggtatagcgcagtccggtagcgcgcctgctttgggagcaggatgtcgggagttcgaatccccctaccccgaccatatttgggtcgttagctcagttggtagagcagttggcttttaaccaattggtcgtaggttcgaatcccacacgacccaccatttttgagaccagtccaggctggaatcgaatcttaagatcagaggccaaaagcactgatcgaagaaggcgactgaaaggtcgcctttttttaccggggtatagcgcagtccggtagcgcgcctgctttgggagcaggatgtcaggagttcgaatccccttaccccgaccatattaaaaatcctcgtatcgaaagatacggggattttttttgcgcgcgaatcctcagctcaccgcaaagcaaatgtgggagggggcttgctcccgatagcggtgtgtcagttaatgaatacttagctgatccaccgctatcgggagcaagccccctcccacaggtattatgcgttgttagtggagtttgaggcgcggttcggtgcctcggccaatcttgctccccaacatcagcatcgccgtacggaagaacccgtacagcgccatctggtgcatgcgatacagcgacacatagaacatccgcgccagccagccctccagcatcacactgccggtcagattgcccatcaggttgcccaccgctgagaagcgcgacagcgaaatcagcgaaccgtagtcggtgtacttataggtcggcagatccttgccttcgatgcgcaatttcagcgatttagccaacagcgaagcttgctgatgtgcagcctgggcccgtggcggcacattgcggtcggtgccgggttgtgggcaggcagcgcaatcaccaaaggcgaagatgttttcgtcacgggtggtttgcagggtttgcagcacttgcagctgattgatgcggttggtttccaggccatcgatgtctttgaggaaacccggtgcgcgaatcccggccgcccataccttgaggctggcgggaatcacttggccgctgctggtgatcagggcgtcggcagtcacttcactgaccgccgagttggtcagcacggtcaccccgagtttctccagggttttatgcactggcccgccgatgcgttccggcagcgcaggcaatacccgcgggccggcttcgatcagggtgatgtgcatgttctctggcttgatacggtccaggccataggcggccagctcatgggcggcgttatgcagctcggcggccagctcgacgccggtggcgccagcgccaacgatggcaacgctgatttgttcaatggcatcggtctgcccggcatgggcgcgcaggtagtggttgagcaattgctggtgaaaacgctcggcctgcttgcgggtgtcgaggaacaggcaatgttgcgccgcaccctcggtgccgaagtcgttggtggtgctgcccacggcaatcaccaggctgtcatagcccagtacgcgtgcaggcaccagttcgcgaccttcttcgtcgagagtggcagccagctggattttcttctgttcgcggtcaagcccgctcatgcgccccagctggaactcgaagtggttccatttcgcttgggcaacatagttgagttcatcttcagaagagttcagcgagccggcagctacttcgtgcagcaggggcttccagatgtgggtcaggttggcgtccaccagcgtgatgctggccttgccgcgcttgcccagggtcttacccaggcgggtagccaactccaggccgccggcgccgccgccgacgataataatacgatgggtcatggggatatctcgcaaggctaaaagaaatcggagcagttaccctcgcgagcgccaggcagctcatagcgtcaggtaactcaataggcggctcagcacaccgagcccgatcaccactaccagcaccacgcagaggagcagccacggccggaaaggcttgcgctcgactctattctgggagagttgcaggtactcttcgacatgctgttggtcatcggggttcaggcggctggtcataaaggcctcgtcaggtagacgttgcaaaagggcgccacgttacagccaggggttggcgctatcgccataagcgtagccggtgcctgtgtcacaggctgatgccaacgtcgaatactatgctgcgccccaggttgttgcgcaagaaatccggtgcatccgggtgggcgaacagcacccgggcgaaggttgggcccaccaacgacagcgagcgccagccttggcgcaaatactcggtggggggcgggaagtggctgttgaggtccagcacttcgcgtttgaggctggcaaaggcgatgagatccaactctcccaggtccatgccgcgctctttgtagttgtgggcttttttacgcagtgtcggcgccaggcgcagcaggaactcatgggccgggatgcgccgtggcttggcttcgcgccgcaccagctggctcaaggagaaagcgctgcgcctgcgcagcaactcgtcgcgccattcgtcgttcaggcgccggccttcgtccagcacgaaaaacacctcgaagctggcgtcgcgaaacaaaacatccggtggctcctggccggcagcgtgaaactcttcgacgcggtagggcacattcaggccttgcagcagacgctggcagacccaacgctcacgctcccatttgcgggcattggatagaaacgcattggcttgttcggctgctacggtgagcaggcgcaaataatctgagtcatccatattcgcagcttagcgttcaaatgatgaccacaggaagtcttgctttaaaacgcaggtgtagactggtcacctggcagcaggcccaaggatgaggtgtgtggtgaggcttattataaaggtagcgcatccgtgatcagtgcagctgttctggcgccatcgaccctcggcatcggctggctgttgtatgcgcctgtgctgatgtgggcgatgttgcgctcgccgtgggtcgaattgttcgccgaccgacggcgccagcatttgctgttcggcacggtgttcgcgctgttcacgctgtggctggtgcgacgggatttcgataccggggtctcttaccactttatcggcatgaccgccgtcaccttgctgctggattggccgctggcaatcgtcggtgggtttgccgctcagatcggcctcatgctgctggggcgccaggacctggccgcgctcggcgtcaatggcctgctcctgatcgggttgccggtgctggtcaccgaaggctgtgcgctgctggtcgagcgggcgcaaccgcgaaacccctttgtgtatatcttctgttccggtttttttgccgcagcgctgtcggccttgctatgcctgttggccgggctgggtttattgtggtttgacggccgctttgcgatgccgcaatggctggaagactttgtgggctacctgtggctgatcatctttcccgaagcctttatcaacggcatggtcatcagcgcattggtggtgttctgcccggaatggctggagaccttcaaccgtacccgctacctctcggcgccttggaaggacgacgattcacggcgttgatccaggtcaaatgccgggcaacggcgcaggtccatgctctgcaaaattttcaggagcacggatcatgagtgtgtatgagtgggcacggcaggagttgcgcagaagccaggatgcggcgcaggagatcggttttgacccaggcttgaccttgcgcgccatgctcagtgcggtagtgcagcaaagcaagggcgtacgcagttttgaagacctggccgacgagctgcaatacctcgcagaaaacctcgacgaccagcaggaatatgcctttatgcggccttagtggcgcggtggcaggtcttcggaaaacagctcgtcttcggcatccggggccacggggatcttgtgttcctcggcggcccaggcgcccaggtcgatgagtttgcaacggtccgagcagaacggccggttgaggttttccgttttccattccacgggggcaccgcaggttgggcaatcgacggtcaagggttggctcatggtcggcctccacgcaaagtaaggtaaaagtggtgcagtcgctcgacctcgccatgcagccaggcaaggtcctggtcattgaccagtacatcatcggcatggttcaggcggtcttcgcggctggactgggccttgagaatcgcctgcacctgttgttcgctgatgccatcgcgctgcagggtacgctgaatctgcagcgattgcggcacgtcgatcaccaggatgcgctgggtcatgctgtattggcctgactcgatcagcagcggtgacaccaggatcgcgtaaggcgaacgggcgcgtgccaggtgactgcgaatttcctcggcaatcaacgggtgcagcagtgcttccagccacaggcgttcttcagggacctcaaagatcagtttacgcagcgcggcgcggtccagctggccgtcggggtgcagcacgccgctgccgaaatgctcggcgatgcgtgccagtgccggtcggccaggctccacgacccagcgagcagcatgatcggcatccaccaggtcgatgcccaggtggataaagtgttcggccgcagcgcttttgccgctgccaatgccgcccgtgaggccaagaatccagggtgttgcgacagaagtggtcatctgaaaccgacagactgcaaatagaagtcggttatttgaccaccccagagcaatgcaatccagccggcaattgccaggcagggaccaaagggcagcggtgctgacgcttgggtcttgcgcaaacgcagcaggatcaacccggcgatcaggcccagcaatgaggccatcagtaatgtcatcggcagtatctgccacccaccccaggctcccagcaatgccaataacttgaagtcgccatggcccatgccatctttaccggtgaccagcttgaacagccagaacacgctccacaggctcatgtagccaatgaccgcgccccacagcgcatcgggcaaggtcgccagcaggtcggcgctgttgaggatgagtcccagccatagcagcggcagcaccagcgcatccggcaacaattgatggtcgaggtcaatcaggctcaggcccagtaagccccagctcagcagcagcaccgcgccggcctgccagccaaggccgaagtgccaggcaacggtggacgagaccaacgcgcaggccagctcggttaagggataacgaaggctgatgcgctcacggcaatgggcacaacgccccctgagcaacaggtagctgagcagtgggatattttcccagggccgaatcggctgttcgcaacgggtgcagcaggaattcgggcacatcaggttatagggcggcccgccgggtgcggcaggcaagccgaggatctcacgggcttgggcacgccattcgcgctcgagcatttttggcagtcgccacaccagcacattgaggaaactgccgacgatcaggcctagcaccagtgccatggcaacaaaaaaccagggccgttcggtcagcagcaggatcaaaatgccgtacccagttgaaagaccggcaggtacagggcgatcaccaacgccccgacaatgccccccagtaccaccatgatcagcggttccatcaggctggtgaggttatcgaccaaggtgtccacgtccgcctcgtagtggttcgcgactttttccaacattcggtccagcgtgccggattcttcaccgatggccgtcatctggatcgccatgcctggaaacaggccactgctggccatggactggttcaattgcatgcctgtggatacatcgtggcgcatacgttcaattgcctgtttgaatggtccattgccgacggcgccggccaccgagcccaatgcctgcacgaggggcacgcccgctgcgaacgtggttgaaagcgtgcgggcgtaacgagcgacggcagagttgtgcagcagtttgcctgccaggggcattttcaacaaacccgcttccagccgatggcgaaagcctgggtaagcacggtaagcctgacgaagccctgccagcgacgcacccaagcccagcgccagcacccaccacgcctgttgcaggaattcggacagggcaatgaccgccaaggtaaacccgggcaattggccgttgaccccggcgaacaggttctggaattgcggcactacgtgtatcaacagcaccgcgctgaccagcgtggcaaccaccagtaccgcaacagggtaggtcatggcctttttgatcctggctttgagccgttggcttttctccaggtgagtcgctattcgctccagcagcaattccagggcgccggcctgttccccggtggacaccaagttgcagtacaggtcatcgaaataacggggatgtaggcgcagcgcatcggccaagctgttgccactggcgatctgctgtttcaaggcttcgaccaggtcacgcacctgccggttctcgacgccctctctgatgatgtcgaaggcttgtagcagcgggataccggccttgagcaatgtggccaactggcgggtgaacagggcgatatccgcaggcaatatacgtggggcgaacgtcggccgaggcgcaggctttttacgcacacgctcgggacagatcccttgctggcgcaattgtgccttgatcagcgcaaggtcattgcctgcaatttgcccggacaccctgcgtcccttgcggttgatgccttcccaggcgtagatcgttgatgtgtcattcatgtcgggttcgtgcacgcaggtagtgaagaatttacagcttagtcagggagcgtgttcgggcaggctggcgttcaggaataaaatgtcagaatgtgcgtcctgtacgcgattggccgcttgggcatgagtacactggcgccgttgcacactacggggcgcaggacgcgccttgtcatggttctattctggagagtgaaagagatgcgtcaaaaaggctttactttgatcgagttgttgatcgtcgtggcaatcatcggcattttggccaccatcggtttgcccatgtacaccaagcaccaggccaaggccaagtttacggcggggctggcggaaatcagcgcgttgaaggctggctacgaagatacgatcaaccagggcactgtgcccactctggagttgatcggtggcaccagcccgacggccaactgcaagatcgaggtgacaggcgatgtggcctcgggtgcaggttccatccgttgtgaaattctcgatgcgccggcgcccgtgctgggcaagaccattaccctgacccgcagcgccaccactggctggacctgcgccaccacggttgaggcgcagtacgctgccgggcggtgagcgagtcagttgctgcatgcccgatgcagtgctagctttagcccactgcccgtgtagctcagccggtagagcagcgcactcgtaacgcgaaggtcgcaggttcgattcctgtctcgggcaccaaggcaccaccgcttcaaaggcaatgttttcagatgatcccagaatggttctgaaggccagacgagctggcattcgtgcccgctcttttgtatctgcgcaaccttgatgacccagatgcatccccattcctcgatctaagagaacgacatgaccacgactgagatgacccaggaagttcggcaccaagcagctctcgaaaaatatctcgaggagtcgccgcagcttaaagaagagatcaaggaactgagcgctgacgaccagcgtgaccagatccagtgggcatttgaggacgaggccgagagccagggctaccagccttgggaactgaccctcaagtacacctcgacgcctgaagagtttgaaactgcacggctggccttgcacaaagaggcggccgaagtgctgggtgtcgagtgggacgagtactgcgagatgaataaccttgtagtttaaagcagcctgtaggcgcgagcttgatcgcgaaaaacgttaacgataacgcgtgaacgttgattgcacgcggtgcccttgaggttttcgcgagcaagctcgctcctacagtcaaggcactttagatactcagacgcatcgacagatccaccgccttcagatccttggtcatcgcgccgatggaaatgtagtccactccggtttcagcgacaggcagcagcgtggtttcgttgatcccgccgctggcttccagcttggccttgccggcgttcaggcgcacggcttcgcgcatgtcgtccaggctcagttcatccagcatgatgatgtcggcacccgccgccagggcttcgcgcaattcttccaggctttccacttcgatttctaccggcttacccggggcgatcttgtgggcagccgcgatggcctgggcaatacctccacaggcggcaatgtggttttccttgatcaggaacgcgtcatacagcccgatgcggtgattatggcaaccgccgcaggtgactgcgtacttctgcgccaggcgcaggcccggcaatgtcttgcgggtgtccagcagcttgacttgggtactggcaacaaagtccgccaggaactgcgcacgggtggcgacgcctgacagcatctgcaggaagttcagcgcacagcgttcaccgctgagcagcgagcgtgccgggccttcaaggtggaacagcacctggttgaggttgacccgttcaccgtcggccacctgccaatgcacggctacccgtgggtccagttggcggaacactgcatccacccacgccgtaccagcgataacggccgcctcgcgggtaatgatcgtcgccttggccagccgttcgaccgggatcaactgcgcggtgatgtcaccactgccgatgtcttccaggagtgcgcggcgcacgttggcttcaatttcggcggtgaggtcggcgagacggagattcggcataacaggctccacaaacaaagtgcctcgattataggggctgcatgcgtttgaacccaggctcgccactcaattacagcgcaaaggcatagtttgctggcgcaactaccctcatttgcaagataatctcgcgccttgcgattggcgtcatagctttgacgtcctggtggtagccgggtgtttgcagtgcctcccgggcctgcccccgttcttcccacctctcaacaccgccgtttcaggaggccaggatgcacaatgacggaaaggtggtgcctttcaacagggcgcaggccacgacatcgccgctcgcgcgcctgccggtggtggtgttgcaggtgcgtgacaaggcggcgcaacagttgcaacagggtttgcaggagttgttcgataacgccgacgacaccctgttcgaaatggctgacaaggcccgcagcaccgtcgaccatcatattttcttcgaggccatgcgtgacctgcgcctcaagcgcaagaacttcgagcgcgtattcatggagcagctgtttgccgcctttggcgacctgggcttggccgggcgcggcgacatgcacctggtgccggtggtgtcttacgaaggcgtgtccggtacaagcgctgatgaggcggaaaaagccgtggcccttgaagcgatgctcagtcgagtacggcatcgcgatggggtggcactggggcagttgagtgcgcgattcagtgaattgcttggcaggcgcctggaggaccatgagaacccactggggccggccttgctttgcgagttcttcctgcaggccggacgcagcctgggggtggagatccgggttaagctgatcatactcaagctgtttgaaaaatacgtgctcagcgacgctgacctgctgtacgccgaagccaatcagctactggtcgccactggggtactgcccgaactcaaggccgttccgtcccgtcgtcccggtgggcctgcgacccgtgaacagcaccaccccagccagtcgatcgccgagccgccgttcgagccaagcggacaagaggccttcagtgccttgcaaaagtggctggtggccgtgcgtggcagcgtagcgccgaccctcgaggccagtaccgagccgcaacccatcgccacccgcgacctgctgcgcctgctgtcgcatttgcaacagtacgtcccggagcccgacgccgaggacgattttgacttgcgcaatcagcttgagcagctactgactcgggtcagcgtcaaaagtggcaggtcgcgggtgctggaagaggctgacgaagatgtaatcaacctggtcgccttgctgtttgagttcattctcgatgaccgcagcgtgccggatgctttcaagggtttgattgcccgcttgcagattccgatgctgaaagtcgcggtgctggacaaaagcctgttcagctgtgcgaaccatccggtgcgccgcttgctcaatgaaatcgcgagcgccgtcataggatggagcccgccgtggaacggcccgcacgattacctctacctgcgtatcgagcaggtcgtacagcggttactgaatgaatttgtcgaagacacggcaattttttcccagctgctggcgcagttcagcgcgtttaccgccgatgagcgcaggcgtagtgagttgctggagcggcacacccatgaagccgagcaagagcgcctgcgtaccgaggctgctcgccggcgtgtggcgcaagcgatcaatcgacggattatgggtaaaaccttgccgcagtttttgctgcagttcctgcagcaggcctggagccaggtgctgttgttgaccacgctcaagcacggcgaacaatccctgccatggcaaacggcgctgcgcaccatggatgagctgatctggagcgttggcctgcagggagacaccgaagcaggtcggcgtttgctcgagcaattacctgggttgctcaaggcgctgcgtgacggcatggccagtgcggcgttcgattcgttcagcacccgtgagtttttccagcagttgcaggccatgcatgtacagtcgtcagagggcgagggcgtcgatgtgctggtcgaagtccgcgaacctttcgtcttcagctcgagtttgccgccaccccaagagcctctgcccgatgatgattccgatttgctcaaggtccagcagttgcgtatagatacctggattgagctgcagcaaaacgacgcccccatcctgcgctgcaagttgacggcgatcatgccgcctgccaatacctatgtatttgttagtcgcacagggctcaaggttctggagcaaaccgccgggcaattagccctggccttcaaacgtggcgcgctgcgcacgttggataatggcttgctgttcgaacgtgcgctggctgcggtggtgggtaacctgcgtcaactcaatcgcggcaagtgatcgcaaccgcggggcggaacgcggcatactggtaacacttagtctcattcaaggagcctgtatgcagttggaccccgccagcggctggtgccagggcatccgtcactgcccttcgcccaacttcaacgagcgccctgaaggcgaaatctcgctgttggtggtgcacaacatcagcttgcccccagcgcagttcgcgactggcaaggtgcaggagtttttccagaatcatctggacgtctcggaacatccctactttgagggtatcgcgcacctacgtgtgtctgcgcattttctgattgagcgtgacggcattgtgacgcaatttgtttcctgtcgggaccgagcctggcatgcaggtgtttccagcttcgagggccgcgaagtgtgcaacgattttgcccttgggatcgagctggaaggtacggacgaactgccgtataccgaggcccagtacaggtcgctgaccgacctgacacgccagctgctggcggcctacccgaaaattacccaacaacgtatttgtggtcacagcgacatcgccccggggcgcaagaccgacccgggccccgcttttgattggacgcgctttcgtagcgccctgcaggatggaggacacgaagaatgagtttcctggtgttggtgctggcggtctggattgagaagttctcggccttgcgcctgcggctgcagcgcgacggcggatggctgcgtgagctggccaggctggaggcgagcccgcgcatgggcaagcgcccctggctgatcctgctgatcatggtgctgctgcccgtggcgttgctggcgctgttgctgctggtgctggagccggtggcctatggcctgctggcattgccggtgcacttgctggtggtgatctatagcctgggccgtggtgatctgttggcagggctgggaccgtttcgtgacgcctggcgacgcggtgacctgcaagctgccgaacacgtggccgagcgcgatctgaatcttggcgcggacagtggcgagcaattgctggagcgcgtccagggctacttgctgtggcaggcgtatcaaagctttttcgcggtgatcttctggtatttcctgctaggtccggtagccgccttggcctatcgcctgttagccctagccagcgaacatagccagaaccccttggtggccgagcgcgccacgcagctgcgccacgcgtttgactggttgccggtacgcctgctggcggcgagttttgccttggtgggcaatttcgtcggggtcagccgtgtgatgctccacgaactgctgagctgggacatcagcgctgcacagctgatggaaaaagtcgggctggccgctgccgaaatcccgccgccggtggtgggtgccgatggcatcaacagcctggatcgcctgtgggagctgttgctgcgtgcggcggtgctgtggtatgccggttttgccatctggaccgtgttgccctaaacattgtgggaggggggcttgctcccgatctaactgatgcaccgcgatcaaaatgtgggaggggcggtgcgacgattcgacttgcccccgatggcggcctgacagccgaccaggatgttggatcagaccgtgtacatatccattgctgcggtaacggcggctattggttccgcttttacagcgggtcacttttgaaaagcgcaaaagtaaccaaaacgctcttgccccaccactcggcacctcgcccaggctcggtgtgcccgtaatccgccatggatttggggggccgccgccacgcgccatccatggcgcggggcggctaaaccggcatccctgccggtttaccccccaaatccctgtcgaattccggccagcgtggtttaacggggcgcctaagatcaaaggcagatcaagatcaagagcggctcgcttcgcatcgtggttactggcggtcgctatgtcagggttgtgtagatatccgtggctatcaggggcaagcccacattgggtctccgcacgcgccgttaaccttacgttacaaaactccctttcaaattgagctatacagacagagcgccaaatagtggctatctgccgccgccctgcgcctcaataaaaataaaagaaggggaggtcacctgtgaagagcttgctctatcccgccgtagcgctgatgaaccgcctgagcttcggcatgaagttcagcctgatcagtgtgctattcctgctgccgatgctggcaaccaactactatctggtgcgtgattcctggcgcgaattccagggcactcgcatcgaactccagagccttgacctgcttggcagcagcctggtgttgcgtcgcgacctggaaaccctcaacaaccaggtgcagatcaacgccacacttggccagtccggcaaggccgctgatcttgaggccaggatcagcgccttggagcagagtgtgctggaccgtttgcaaggcttgagcgccgtggcgagcgagcccgagcacgtcaccgtttttgaaagcaagcgcgacgagttgatcgccgcgttcaaggcgcagcaacaggaaagttcgttgctcaacaaaacggcgctgatcggcaaattacttaaccaggcccagatgctcagccagattattgccagccaagccggcttgagccgtgacgcgcaaagtgatcttcgccagctctccgatctggtcactactgtcaccccgcaagtcacccaggcccttggggaggggcgtgcgatgggcgcgtactctctgggccaagggtttatcaactcttcttccagcacacgctttgacgaattgctgcagcagttggaaaaactccagggcgaatatggcttgaaactgcaggacgcactgggcgccagccatgccgcacatgcgaccctcgacaccctggcgcaagccagccaggccagcctcaagcaaggcagcgaattgttcgaagaacgggtggtgatggccgagaccctcgacacagcgtggcaggggttttacgacagcgtcagccaactgatggccaagacatatcaactggatgacgccaccttggcgttcatcgggcagcaactggagcaacgcctggcacaaaaccgactgcacatggtgctgctgatcgcggcactggcggcggtatttgcgctgattttctacttatatgcaggcttcttcgtatccacccgtaccaccttgcgtcgcctgggggtaatgatggacaaagtggcggcaggtgacatgacggtcaccttcgtggcccaaagccgcgatgagctgggggacttgggccaggtgttcaatggcaccgtggccaagatccacgacttgatcgagcgtgtcgggcatacggtcagccaggtcgagctgcaggccggccaggtccaggcggtttcggcacagagcaaccaggcggtatccggtcagcgcagccagatcgaacaagtggcgacggcgatgaaccaaatgtcggccactgcccaggaggtggcgcgtagcgcggcggcggcagtcaacagcgcccagagcgtcaatgatgaaaccgtcagtgggcgggcgctggtgcaatcacagcaaggcggcatcgcacgcctggcttcggagcttgatgagtcggtgcgggtgatcaaccagttggccgccgacagccaggacatcagcagagtcttggaagtgatcaagagcatcgctgagcagaccaacctgttggcgctcaacgcggccatcgaagccgcccgcgccggtgaacagggccgaggttttgccgtggtggccgacgaggtgcgcaccctggcccgacgcacccagcactccaccgaagaaatcgaacaaatgatcagtcgcttgcacagtggcgtcggcgcggcggtgaaggccatgggcagcagccatgaaatggcgagtggcacggtggggcagtcggaaaaagtccagcaagccctggagaatatcctcggcgccgtagggatgatcgttgaccagaaccagcagattgccgctgccgtcgagcagcaaacggcggtcgcccaagacatcgaccagaatattgtcgaaatcaatcgcgctggcgagcatgcggcgcaaggtgcccaacagaccgaagcggccagccggcaattgtcggcgcaggtcattgagttgaagcaattgatcggggcgtttcgagtgtaggaattttctgtgggattgagcttcggattgcgtggcgcatatcctgatttgtcggactgtgttttatcgcggcgtggttaggtgagaatttatttcatccgtcacggtcacgaggagacacgacgatggccgctgcaatcggtatcaaggggcattgcgcccagtgcgacatgacgtttgaactcaagccttggcaattgaatgccattgctgttgatataccttttgactgtacgtattgccactgcggcttgcagctgtgttgcctcaaacagttgcgtcggtttcgcgctctcgaccagtgggcgttggtgcgcccgagcatgatcatgctgacgtgcgcgaccttggtggtggccctgattgcagagtggttggggctgctcagcatgattgcgcagttcaacctttcactggttacggtgttgattcatttcctggtggtgcgctacgcccgtcatcgacagcggatgaccttgaagttgcaggtcatcagcccgctaccagttgaacaactcgcacgcattgcgtgtgctcgtctcagccagcaatgaagggctgattgccatgcgctgcgccagcgctacgcagatgtccggcaggtgctgcgggctgttgcgctggttgggatacatggccggggccatatccggcgaatcggtttccagcacaacagcgtcaaggggcaactgggcaagtaccttgtgcatgcgcagggcttggggccaggtggcggcgccgcccagaccaagcttgaaaccgagcttgatgtactcgcgggcctcctcgacgctgccggcgaacgcatggatgatcccgccccgcggcaggcggatgcgcttgagggtggcaatcacggcggcgtggctgcggcgtacgtgcagcaaggccggcagttggaaatccgccgcaagtttcaactgggcttcaaacaggctttgctggtgctcgcggtcgaggtgctcaagaaagtaatccaggccaatttcgcccacggcgcatagttgccggtggccttgcaggcgggtcaaccagtcccccagctccagcaggtcggcagggcgatgttcatcgagatacaccgggtgcaagccgagggccgcgaacaagccgtcgtcctcctgcaccaaatcccacagccgctgccaatttctctggtatacgcccaacaccaccatgcgctgtacgccgagttgacggctataggcgaggacttgcgggcgatcgtggtcgaaatccgcgaagtccaggtgggtgtgggtgtcgatcagctccacgctcaggcctcgtgaatacgctgcttgaaggtccgcccaatggcgtgcacgcccggttggtactgttcttcctcaatggcggccagagccaggcgcagggcggtctcggcgatcaactggtgttgctgggccatggcgttgaccggcagtggcaggaaatccagcagttgggtatcgccgaaggtgcccaggcgcagggggcgcgacctgagggggaagtcatgcagtgcgtcgaacacgccttgcagcagtacgtaggaggtggtcaccagcgcgtcgggcaaatgccccaggcgttgcagcagttgttccatcaactgtcggccgcagtcacggctgaaagcttcgccctgttcgatgatcacttcgccgttgaagccttgcagcgcttgacggaaaccggcggtacgctcctggctgatgctcagttcggggtgtgcgccgatcagcgcgatctgcttgggcagcggttgcagcaggctgctggtgagttgctggcaggcctggcggtcatcgctgaccaccgagcagaattggccaggctccatgacccggtcgatggcgatcaccggcaaccccttggcttgcagctcgcgatagctgtcatccgtggctggcaggcaactggcgacgaacaacgcatcgcaacgccgcgcacggaacagttgcagtagttggcgttcgctggcggcttcgtcatctgaactggcaatcaacaactggtagccccgcgcccgtgcaccttgttccagcagcttggcgatgcgtgcgtaactggggttttccaggtcgggcaagatgaaccccaaggtgcgcgtatgccggctgcgcagcccggcggcttggggattgggcgtaaagccatgggcctgaaccacggcgcgcacgcgctcaacggttgcattgctgatgcgttgctgttcggccttgccattgatgacatagctggcggtggtcacggacacaccggccagacgtgcgatatcactgagtttcaaaccgggatttccttgttttttagagcgtgccccgacattttgtccaatcgtaaccgattccagcccacgaccaatgtcccagagcaagcgccgagtggcccttctagcttgcgcaattaacgcgtaatctgccataaattctagattaaacgtttcagcaggcgtatttttacgatgttcgccactgagtgaccactgccaattgaccactcagtcagttatttttgaacgtctcgcgctgatcaattcaaaacaatacctagtgcgcacatcgcactaactaggagaacggcatgcttgagctcaccgtagagcagatatccatgggccaggtggctgtggataagtctgctgccttgcacctgctcgctgataaattggtggccgatggcctggttgccgagggttatctcagtggcttgcaagcccgtgaggcccagggttcgacttttctcggccagggcatcgccattccccacggcacgccagaaacccgcgaccaggtattttccaccggtgtgcgtttgctgcagttccccgaaggggtggactggggcgacggccaggtggtctacctggcgattggtatcgcggctaaatccgatgagcacctgcgcctgctgcaactgctgacccgcgccctcggtgaaaccgacttgggccaggcactgcgtcgggccggcagcgccgaagccttgttgaagctgttgcaaggcgccccccaggagctggcgctggatgcgcagatgatcagcctgggcgtatctgccgatgattttgaagagctggtatggcgcggcgcacgcctgctgcgtcaggccgactgcgtgagcaatggttttgctgcagtgctgcaacaagttgacgcgctgcccctgggcgatggcttgtggtggttgcacagcgagcagacggtcaagcgcccgggcctggcgtttgtcacgccggacaagcccatgcgctacctcggccagcccctgcacggcctgttctgcctggcgagcctcggtgaagcccaccaagccctgct

SEQ ID NO: 8 - DNA, 1048002 bp, Pseudomonas fluorescens KENGFT3
  misc_feature (753347)..(753347): a, c, g or t
tatcccctgtgtgccttgttgattgaagggcgcggccaggaactggggcgtgccaccagcagccgtgcggtgctggaagtgctgggcggcgaactgcctgcggattggcccagcgcccgcatcaccctggccaacgcccatggcctgcatgcgcgcccggccaagatcctcgcgcaattggcgaagagtttcgacggcgatatccgtgtgcgtatcatcgatggcccggtgggcgccgtgtcggtcaaaagcctgagcaagttgctcagccttggtgcgcgtcgcggccaggtactggagttcgttgccgagccgacgattgccggcgacgcattgcccgcgctgttggccgcgatcgaagagggccttggcgaagacgtcgaaccattgccgagcgtgagcgcccaacctgcccaggtcgatgtcgagccggtactcagtgcgccactgagtggtagccagctccaggccatcgccgccgcgccgggcatcgccatcggcccggcccatatccagattccacagctgtttgattaccccctgcgcggtgagtctgccgcgattgagcgccagcgcctgcacacggccttgaacgaggtgcgccaggatatccagggcctgatcgaacgcagcctggccaaggccatccgcgagattttcatcacccaccaggaaatgctcgacgacccggaactgaccgacgaagtcgacacccgcctcaagcagggcgaaagcgccgaagccgcctggatgagcgtgatcgaggccgccgccaagcagcaggaagcgttgcaggacgcgttgctggccgagcgcgccgccgacctgcgcgatatcggccgtcgagtgctggcgcaactgtgcggtgtcgaaaccattcaggcgcccagcgagccctacatcctggtgatggatgaagtcggcccttcagacgtggcacgcctggacccggcccgcgtcgccggtatccttaccgctcgcggcggtgccaccgcccacagcgccatcgtcgctcgcgccttgggcattcctgccttggtcggcgcaggcgctgcagtgttgctgctgaacgccggcacaccgctgttgctcgacggtcagcgcggtcgcctgcatgtcgacccggacgctgccactctgcagcgggccgtggtcgagcgcgatacccgcgaacaacgcttgcaggcggcgtcggcccagcgccatgaaccggcgctgacccgtgacggtcacgccgtggaagtgttcgccaatatcggcgaaagcgccggggtggccagtgcagtggagcagggcgccgaaggcattggcctgctgcgcaccgaactgattttcatggcccacccccaggcaccggacgaagccacccaggaggccgaataccgtcgcgtgctcgacggcctcgacgggcgcccgctggtggtacgcaccctcgatgtgggcggcgataaacctttgccgtattggcctatcgccgaagaagaaaacccctttcttggcgtacgcggcattcgcctgaccttgcagcgccccaagatcatggaagcgcaactgcgtgcgctgctgcgttcggcggataaccgaccgttgcgcatcatgttccccatggtcggcagcgtggatgaatggcgcgcagcccgggacatgaccgagcgcctgcgcctggaaatcccggtggctgatttgcagttgggcatcatgatcgaagtgccgtcagccgccttgctggcgccagtactggccaaggaagtggacttcttcagcgtcggcaccaatgacctgacccagtacaccctggccatcgaccgtggtcacccgaccctgtcggcccaggccgacggcctgcacccggcggtgttgcaactgattgacatcactgtgcgtgccgcccatgcccacggcaaatgggtcggcgtctgcggcgagttggcggcggatccactggccgtgccggtgctggtcggcctgggggtggatgagttgagcgtgtcggcccgcagcattcctgaagtgaaggcgcgggtacgtgagttcagtctgagcgaggcccggggcctggcgcaacaaacactgttggttggttcgcctgccgaagtgcgtgcccttgtggaggccgtgtaaatggcgaagattctgaccctgacgctgaacccggcgttggacctcacggtgcgcctggcgcgcctggaaccgggtgcagtcaatcgcagtgaagcgatgctcacccatgcggcgggcaagggcgtgaacgtggcgcaagtgctggcggacctgggccatgacgtcagcgtcggcgggtttctcggtgaggcgaacccccaggctttcgatgcgctgatcagccgccgtgggtttggcgatgcgttcgttcgcgtgcccggcgaaacccgcagcaatatcaagattgccgaacaggacgggcgtgtcaccgacatcaatgcgccggggccgctggtgagtgaagaggcgcaacacgcactgctcgataaggtcgcaatgatcggcgcgcaatttgacgcagtggtggtggccggcagcttgccgcgtggcgtcagcccgcagtggtttcaggggctgctgcagcagttgaaaggcctcggtttgaaagtcgccctggacaccagtggagaagcgttgcgcaccggtttgcaggccggcccgtggctggtcaagcccaataccgaagagctggccgaagccttggataatgccaccgatgccatcggccaactgcatcagcagggcgtcgaacatgtggtggtctccgacggtgctgcgggtgtgacctggtaccgcccgggtgcagcgctgcacgccacgccgcccaaggtgacggtggccagcaccgtgggcgccggcgactcgctgctggccggcatgcttcatggcttgctcagcgacgaagcagccgaacagacattgcgccgcgccacggcgattgccgcgatggccgtaacgcagatcggctttggcatcagcgatgacgcgcagttggcgcacctagaaagcggcgtcgatgtacgcacgctgacagaacaataagagggtttgtgatgaagttagccattgttaccgcctgccccaacggcatggtcaccagtgtgctgtgcgcccgcttgttggacgccgccgcccagcgcatgggcttgcacaccagtgtcgaagtcgtcgacgtgcagcgcccggagcgccagttgtcccaggccaccctcaatgacgcggaatgggtgttgttggtcagcagcacaccggtggacatgcagcggtttgtcggcaagcgcgtgttccagaccaccccggcccaggccctggcggatgtagaggccgtattgcgtcgcggcgccgaagaagcccaggtatatgtcaccagcggcgccccggtggcggcgaaagatgcgccgcgtatcgtcgcgattaccgcctgcccgacgggcgtggcccacaccttcatggccgccgaagccttgcagcaggccgccaaacgcctgggttatgacttgcaggtcgagacccagggctcggtgggcgcccgcacgccgttgagcccggaggccatcgccaatgccgacgtggtgttgctggcggccgatatcgaagtcgccaccgagcgttttgccggcaagaaaatctaccgctgtggcaccggtattgccctcaagcaatccgaagccatcctcaacaaggccctggccgaaggcacagtggaaagcgcagccagcggcgcgccggccaaatcggagaaaaccggcgtctacaaacacttgctcaccggcgtgtcgtacatgttgccgatggtggtggcggggggcttgctgatcgccttgtcattcgtgttcggcatccatgccttcgaacagcccggcaccttggcggcagcgctgaaaagcgtcggtgaccaggcattcctgctgatggtgccgctgctggcaggctacattgcctattcgattgccgaccgccctggcctggcgccgggcatgatcggcggcttgctggcgggtacgctgggcgcgggctttatcggcggcatcctggcgggtttcgtcgcgggatactgcgtcaagttgataagccgtgcggtgcgactgccccagagcctggaggcgctcaagccgatcctgatcatcccgttgctggcgagcttgttcaccggtctggtgatgatctacctggtcggcccgcctgtcgcccggttgctgtccggcctgaccgattttctcagcaccatgggcaccaccaacgcggtgctgctgggtattttgctcggcggcatgatgtgcgtggacttgggtgggccgatcaacaaggcggcgtatgcgttttccgtgggcctgttggcggcgtcgagtggtgcgccgatggccgcgaccatggctgccggcatggtgccgccgattggcatgggcatcgcgaccttgctcgcccgacgcaaattcgcccagaccgagcgcgaagccggcaaggcggcgatggtcctgggcctgtgctttatctccgagggcgcgatcccgttcgcggccaaagacccgctgcgggtgatcccggccagcattgccggtggcgccttgaccggtgcgctgtcgatgtactttggctgcaaactcgccgcgccccacggcggcttgtttgttctggtgatcccgaatgcgatgaaccatgcattgatgtatttgctggcgattgtggcgggcagcgtgttgacggggttggtgtatgcgctgcttaagcgaccggaagctgtggaactgacggtcactgctgccaagggctgatgggattcaaaatatgggaggggcttgccccctcccacatttggattttccttggctgtaagggtggtgtcatatctgcttcatccccgcatgctttagtgacccttttgatactcaagagggcacctgcatgagcgacttcgatctcggccgccgccgtgtgatgcaagccgtcggcgctggtctgttgttgccgggcctggccccggcggtgatcgcttcggtgaaggaccggccgcaactcactgacggggtgcagtccggcgacctgctcggcgaccgtgcgatgatctggagccgcagcgaccgcccggcgaagatggtggtggagtgggacacccgcagtgtgttcagtaacccacgcaagttcatctcgcccctggccgacagccgcaccgacttcaccgcccgcgtggaactcaccggtttgccggtggaccaggcgattttctatcgtgtgcatttcgaagatgcccagaccggtgtcgccagcgaaccctggttcggccacttgcgcagcgtgccgcaacagcgccgcgacatccgctttgtgtggagcggcgacaccgtcggccaaggctttggtatcaacccggacatcggcggcatgcgcatctacgaagccatgcgcctgcgcctgccagacttctttatccacagcggcgacaccatctacgccgacggcccggtgcccgcgcaactggtcacggaaggcgggcgcatctggcgcaacatcaccacccaagccaagagcaaagtcgccgaaaccctggatgaatatcgcggcaattaccgttacaacctgatggatgagaacgtgcgccgcttcaatgcccaagtgccgcagatctggcagtgggacgatcacgaggtgatcaataactggtcttccagcaagcagttggacgagcgttaccagacccgcgacatcaatacccttgtcggtcgcgcgcgccaggcctggctggaatattcacccatgcggcggcagagcgcagacggtggcgggcgtatttatcgcaagctcagctatgggccgctgctggatgtatttgtgctggatatgcgcagctaccgtgggccgaatgacgacaacctgggcggcgagaaaccgttcctgggtcgcgaacagttggattggctcaagcgagaactcaaggggtcgcaagcgcagtggaaggtcgttgccgccgatatgcccatcggcctgggcgtgcctgacggtgaggtaagccctggcgtgccacgttgggaggctattgccaatggcgaccctggccaggcgcaagggcgtgagttggaaatcgccgagctgctgggctttttaagagcgcaacaggtgcgcaaccatgtgtggctgacggccgatgtgcactattgcgcagcgcaccactatcacccggaccgggcggcgttccaggatttcgagccgttctgggagtttgtggccgggccgttgaatgccgggagtttcgggcctaatccgctggataaaacctttggcccgcaggtagtgttcgagaaagctccgcctgcgcaaaacacttcgccgtttgctggctttcagttttttggtgaagtgcagattgatgggcagacggcagaattgaccgtgattttgcgcgacctggacgggctgtcagtgttcgaacaaaagctgcaacccgtctaggcgatcgttcccacgctccgcgtgggaacgatcagggccaacaaaatctcagtacacatcccggcgatagcggccctgttcaatcaagcgctccaccgcctcattacccaggatatccaccaacgcctgatccacccccgtcgccatcccctgcagactgccgcatacataaatcgccgcgccatccgccagccatttgcgcagcacatcggccgattcgcgcaggcgatcctgtacgtagatcttctcttcctgatcccgggagaacgccaggtcgagtaaggccaggtcgccactggcgagccagccttgcagttcgtcctggcacaggtagtcatgggcgatctggcgttcgccaaacagcagccagttgcgctgctggccatcggcgatgcgtgccttgagcaagctgcgcaggcccgccaggccggtgccgttgcccagcaggatcagcggcaccggcgcatccggcaggtggaagccgctgttgcggcgcaggcgcagactgatgcccgaaccgatggccgcatgttccgtcagccagccagagccaaggcccaggctcccgtcgggatggcgttcctggcgcacgatcagctcgagcacaccgtcgctggcgatcgaggcgatggagtattcgcgcatgcccagggggaccagtgcgttcaccaaggcttgggcatgcaggccgaccaggtgcgcgcggttgtccggcaattggcgggtggccagggcttggtcgagggtgtgcgccaagccgtcgatcaacacgccgtcgctgccggccaggcccaggccatggaggaagtgatcaatggcccaggggcagtttcgcggcaggatttccaccaggtcaccggcctgccagctttgcgccgtgggcggtgtgaggcccagcagatagacgtcggcgccgacgctgccagggttgagcagggtgcgttggctcagtgtccaggtttcatattgggcgggttgccaagccgccgctggcgcgtgaccggtgagttggccgagttgctgttgccaggtcagcaaggcctcagtgtcgccgctgtcgacttccaccggggcgaacagtgcattgccaccctggttggtcagccagaaatgcaggcgccgggcaaagccgcagaagtgttcatactgacgatcacccagggccaataccgagtagttcaagcctttgagcggtaaatcctgaccgagcactctgcgctcaaaaccccgcgcgttgtcgggggcttcaccgtcgccgaaagtgctgaccacgaataacgcatgttccgactggctcaggtcgtcttggctgaggctgcccaggggctgcaccttcaccggcaggcccgcggcttgcaactggcctgccgtttgccatgcaagttgttcggcaaaaccgctctggctggcaaagccgatcagccaggccggcgcatcgctgtgattggtcgtcaggccctggcgggcatcgcgcacctggcgcttcttgcggcggcggtcgaggtacagcagccagccggtgataaagaacaatggcattagcaacgagctgacggtgaggatgatgcgtccgatcaggccgaaatagctgccggtgtgcagcgcatagacactggtcagtaattgcgatttgaggctcttgctggcgtagcgctcgtgggatttgacctcgccggtggccgggtccaggttgatctggttcagcgcacggtcatggggcgagtctttgagcaggtaatacacggtggccggttgcccggcgacggctggcatgcggatgttgtaggcactcaggtcggggccggcactgctgtagatgctgctccagatcgcgtcatagttggctaccggagcagggccggcaggtggcgggccgcgtttgcgcatgcgctcgttttgcggcgcgtcggagagcagtttggtcatgccctggttgtaccagtcgtaggaccaatacagtccggtcagtgccgccaacagataaaacagcagacaccaggtgccgaataccgaatgcaggtcccagttgaaactgcggcccttcttgcgccagtccagggtcaaccatacccgccagttttttacctgtcgcggccagcgcagatataaaccggagaggcagaaaaacaccaggatcagggtgcaggcgccggtgatgttgcgcccggtttcgccgacggcgaggaagcggtgcagttgcaaaataaaaccaaacacatcctggccgacggcgtcgcccaggtagtcgccggtataggggtcgaagtagcgcatctggccacgacgctcccccggcggcggggtgaaggatacccgggcggcgttgccgctgtcgctttccacccacagcatcgcaacgctcttgccttcggcggcctccagcttgcgcaccagttcggcaggcggcagcacgccggcttcgcgcttctgtacgctgagtaccgtagggttgagtgctcgcaggatttcatcctggaacgagtacgcggccccggtgacccccatcaaggccagcaccagcccggcagtgatgccgaaaaaccagtgcaactggaacagggttttcttcaacacgtcgggccgcctcgctcatctggatatctatttcacggcgcgcattatgccgtggcttaacgagaaaaattctgttttacacacaaaagccccacgcatccgatgcgtggggccttgggtcgtacgttggctgctcttagaagtggaagctggtggtcaacaacgcggtacgaccggccgcctggttggcgaagtgcgccgagtaggccttgtcgtagtaggtcttgtcggtgaggttctgcacgttcagttgcaggtcgacgttcttagtcagcttgtagctggccatggcgtcatagcgggtgtaggacggcacgtacacggtgttgccggcatcgccgtaaacctcatcgacgtagaacgcgccgccgccgacggtcagcttcggcgtgatgtcgtaggtggtccacaggctgaaggagttcttcggcgtgttgggcatctggttgcctttgttggacccggcactcaccacaccgttacgcccgttgaggccggacttgaccaactcgctgtccagataggtgtagccggcgaacacttgccagtgatcggtgagcttgccgctggccgacaattccacgccgtcgacctgagactcgccgccgttctcgtaggtgagggcatccaccaggatgcgggtgtttttcttctcggtacggaacacggcagcggtcagggacagacgatcatggaacaggtcccacttggtacccagttcatagttgacggtttcttcaggctgcaagtcgctggttgccgcaccggcagacagcgggttgccgtcggcaccttcacctaccaggccaccggctggtgaggccgaggtggcgtaggaggcgtagatgctgccgttttccagtggtttccagacaaggccggcctgccagttgaagaactggctgtcatccttgatcttggtgcgtccggtagtggcgttggtgttggcttcggtatcgaaggtgtcgtaacgcaggccgacgttcagcagccatttcggatccagctcgatggtgtcgaacacataggcggcgcggctggtggccttggtgttggtgccgttgtagttgcgcgcgacactgccgttccaggcgtcgtctgggttcgggttgccgagtgaggtgcactggccgcccacgctgcccttggccgggctgcacaccgggttggcattggggctgacggtatagccgctgacgcgggtttcttcaccggtaaattccaggccggtggagtagctgtgcttgaagcccagggcctggaagctgccgaacaggtcggtctggttagtggtcgtggtggttgtggacacgcggctgttagcgcgacgccatacggtgccgaacttgttgacgttgagtttgctgtcatccggttgggtcagcacatagtcctgaccggtgctgccgtgacgcagggtgtttttcaaggtcatgttgtcgttcaggtcgtgctcgatggagaacgtactgatatcagcgcgagttttacggaagtcgcggcttttcaaaccgtagaaattgttgctgtcgccgccatcggtgggtttgtcgtgcacgtgggcagtggcagtcgacgaaccatagccatagggaatgcccgaatccggcaagtcatcgctttccatatggtagtagctgaggttgacgcgggtcggcgtgcccaggccaaacgtcagcgacggggccacgccccaacggtcgtagttcaccgcatcgcggccggcaacgttttgttcgtggctcatcaggttcaggcggaaggcggcactgtcgtcgaggaattggcggttgacgtcgagcacgtagcggcgggtctggtcggaaccgtaggtgaagccgccgttggtgaagtcccgcgcttgtggggtcttacttaccaggttgaggctgccaccggccgacccacggccgccgaacgaggagttcgggcctttgctgacctcgatcgactcgatgtcgaagatctcacggctctggccgccggtatcgcgcacgccgtccaggtaagtgtcgccctgggcatcaaaaccacgaatgaacgggcggtcgccctgtgggttgccaccttcaccggcaccaaaggtaatgcccggtacggtgcgcagggcatcctgcaacgaggtagcggcggtgtccttgagtacttgttgcggcaccacggtgaccgaacgcggtgtgtccaccaacggcgcggtgtatttctgagaagaggctttttccacctgataggaggtgttgtcctggtcctggccggtaatgttggtggcgccaagtgagatagggttgcgctcgcctttctgctcggtgttttccgctgcctgcgccaggtgggcggcagagctggcactcaaggctacaccgatggccgaggccagcatgcgtggtgaactggctggtgtttttataagaatgcgcgacatgacgtgtcccttccccaaggatgtgaggccgcggaatatagggccaacaagactttgtatcaattgcgagatattgctattcgcatcgaatttacattctttacacttttttcttacggtttttgcaatctcgttcgtccccgagttttacagggtagataagaatcaatactattggcacctctctgattgcaggtattgcctcatgttgctgcacattcccggcctgttttctcgcgaggaggtgctgcgcattcgccaagccctggaagaaaccgagtgggctgacggcaaaatcactgccgggcatcagtcggccaaggccaagcacaacctgcaattgcccgaaggccaccccctggccaaggaaatcggcgcggccatgttggaacggttgtggagcaacccattgttcatgtcggcggcgctgccgcacaaagtcttcccgccgctgctcaactgctacaccgctggcggcagtttcgactttcatatcgacaacgccgtacgccaacccaaaggcagccctgagcgtgtgcgtaccgatctgtcgtccacgctgttcttcagcgacccggacgaatacgacggcggcgaactggaaatccaggacaccttcggcctgcagcgggtcaagctgcccgccggcgacatggtgctgtaccccggctccagcctgcacaaggtcaacgccgtgacccgtggcgcccgctatgcttcgttcttctggacacaaagcctggtgcgcgaagacagccagcgcaccttgctgttcgaaatggacggcgcgatccagcaactgacccgcgacgttcctgaccacccggcactgatccaactcaccggtacctaccacaacctgctgcgccgctgggtcgaggtctgagatgggatttttattgcgtcgccaggaagtgctcaacgtcgagcaattgcagtccatgctcgacgattccccggtgcgcgctgcccaggcgatcctgatcgccgccaaggcaggcgtggtcgaggcccaggccttgctggggcaaatcctgctgcaagggcgtggcattgcacgcgatgaagcgctagcgctgcgctggttccagattgcggcgcagggcgggcatttgatggcgcgcaatatgaccgggcgctgcctggagcagggttggggctgtgccgtcgatgaagcagcggcagcccgggagtatcggcaggcggccgaagccgggttggattggggccagtacaactacgctaaccttctggccaccggccgcggtgttatgcaggaccaggcccaagcactagcgatttatcgtcaggccgcagggcagggccacgccaagtcgatgaacctggtggggcgttatctggaagatggccagtattgccccagggatctggaagcggccattgagtggtaccgacgctccgccgaagccggggattttcgggggcagttcagctatgcagcggtactggcggacagaggccagatcgacgctgcgctggaatggctacgcaaggcgttggcggctgggaatctcaagttcctgcgaacggcgtacgaggcgctggcgctggccaatgacccgcaaattcgcgccatggccggtgcctatcaacaacgtgccgcgtccttttcctgaggcaaaaaaaacccatgacttgtcatgggttttttataggcggcggtcttacacgtagaacgatttcaacggcggaaacccgttgaactcaactgcgctgtagctggtggtgtaggcaccggtcgacaaccagtacaaacgatcaccaatcgccaggttcaacggcaaaccgtacttgtagttctcgtacatgatatcggcgctgtcgcaggtggggccggcgatgaccacttcttccatctcgcctttcttctcggtccagatcgggaacttgatggcttcgtccatggtttcgatcaggccggagaacttgcccacatcggtatacacccaacgctcgacggcggtgcgcgatttacgtgcaaccagcaccacttcactgaccaggatgccggcgttggcgatcaacgagcggcctggctccaggatgatttccggcaggtcgtcgccgaaatcttccttgaggaaacggatgatttcttcggcgtaggtctccaggctgttggtgcgggtgatgtagttggccgggaagccgccgcccatgttgatcagcttcagctcaatgccatcttcttctttcaaacgttcgaagatcaccttgaccttggcgatcgccgcgtcccacacgctgatgtcgcgctgttgcgagccgacgtggaacgagatgccgtacggcaccaggcccaggtcgcgggcgaggatcagcaggtccatggccatgtcggtctggcagccgaatttgcgcgacaaaggccagtcggccgtggtcgagccttcggtgaggatgcgcacatacactttcgaacccggcgcggccttggcgatgttgcgcaggtcggcttcggagtcggtggagaacaggcgcacgcccttctcatagaagtagcggatgtccttggatttcttgatggtgttgccgtagctgatacggtcggcgctgacgccgcggtccatgaccttgtccagctcgtagatcgaggcgatgtcgaagctcgaacccttgtctttcaacaggtcgatgatctccacggccgggttggccttgaccgcgtaatacaccttggcgaattcgaaaccggcgcgcaggtcatcgtaggcctggctgatcatcgcggtgtcgatcaccacgaacggggtttcttgcttgtcggcgaacgccttcattttgtcaaaggtggcgcgcgcgaaatagtcttcgacgttgatcgacatgctggggactcctaggggcaaactgtattaatcaatgggtacaactgaacgtcctccgtatccccactttggttcgcctacttcccaaggcatgtcgccgaaagcaaaaaggccacggggtaagcttcccttggccttgctgtctcgtcgtcagtacttgagccggatggatcgtttccagcatggacgttcggcgcgaactttagggcttgacgggcgtgggatcaactaaaaatgtcgcgtttttgcacgcgttcgtcgtacggccgcgtgcagctacttatgtaaccgaccggtgtgacggattgatgttccccgctgagtgggaattgaggacatttccctgactcaccgaggggcaaatgtgggagggggcttgctcccgatagcggtgtgtcagtcacttctcagtcactgattcaccgctatcgggagcaagccccctcccacattttttatccctgttgtgtcaggtcaggccagggcggtctcggccggcgagacaatactggtcttgccgccacgggacttgccggaactcaggtactcggcaatcgactcctgggtcacttcacccaggaacacccgctccgcatccatcaccggcaaccacgagcggttgaactcatacatgcgcgacagcaggatgcgcaaatgctcgtcgtacgcggcggtggcgttgaactcgcgcaggtactggccgcaggtaccggcttgacggtgcaagtcgcgacggcgtacataacccagcgccttgttctcggcacaggtgaccaccacgtagcggcggtcgtgctcgtccatcagctccagggcatcggccaccggggtttccgggctgaccgacggggcgttgtccgccgcgtcttcggccttcaccaacagcaggcgcttgagggtgctgtcctggcccacgaagttgctgacaaactcgtcggccgggtgcgccagcagcgtgtccgggtggtcgatctgcaacaacttgccggcgcggaagatggcgatcttgtcacccagcttgatcgcttcgtcgatgtcgtggctgaccatgatcacggtcttgttcagcgcgcgctgcatctcgaagaactcgttctggatcatttcgcggttgatcggatcgaccgcgccgaacggttcatccatcagcagcagcggtgcgtcggccgccagggcacggatcacgccgatgcgctgttgctggccgccggacagctcacgcgggtagcgatgcaggtactgcttgggttccagcttgatcatgctcatcagttcgcgggcgcggtcgtggcatttttgcttgtcccaaccgagcagcttgggcacgaccacgatgttttcctcgatggtcatgttgggaaacaggccgatctgctggatcacgtagccgatgttgcggcgcagggtcacttcgtccaggtcagtggtgtcttcaccgttgatcaggatcttgcccgaggagggcttgatcaggcggttgatcatcttcagcgtggtgctcttgccgcagcccgacgggccgaggaatacacaaatctcgccttcgttgacggtcaggcttacatcgttgacggcggtgatggtcttgccgttgctttgaaaagtcttggacaggttttgaagttcgatcatttgagcaatccttttggagtcagcgagcgttgcagccattgcaggagcaggtcggcgaagatggccaggagactgaccagcacggcgccgacaatcagcatcgacatatcgctgcggctgatggaagccagaataagtacacccaggccaccggcaccgatggtggcggcgatggtcatcacgccgatgttcatcaccacggcggtgcgcaccccggcgaggatcaccggcacggcgatgggcagctcgaccatgcgcaggcgctggccgaaggtcatgccgatgccgcgtgcggcttcgcgaatacccggttccaccccggtgagggccaggtaggtattacgcatgatcggcagcagggagtagaggaatacggcggtgatcgctggcatcggcccgaggccctggccgaacttggagtaaaagggcagcagcaggccgaacagggcgatggacggcacggtcagcagcaccgtagcgctagcctgcaacggaccggccagggtcgggaagcgggtcatcagcacgcccaggggcacgccgacgacgatcgccaggatcactgcgatgccgaccagggtgatgtgctgccaggtcaggtgcaggacttgggcccaatcaagatgggaaaaggcgttcaaaaattccatgtcttctccttcttagttgatcggatgttggcgcaggaaatcggcggcgacagcggacgggctttcgtggtcgacgtcgacccgcgcattcagctcgcgcatggttgcgtcgtcgaacagctcggccaagggcttgagctctgcggccaattgaggatgctggtcgagatattcctgacggatcaccggagctgcggtgtagtccgggaagtaatgcttgtcgtcggccagcagcttcaatttgaacgcgttcaggcggccatcggtggtgtagaccagaccggcaaacacctggccattacgcagggcggtgtagaccaggccagcgtccatctgccgggtgtttttgcgcgtgaggttcatgtcatacaacttgaccatgccgcccatgccgtcggaacggttggcgaactcggtgtcgagggccaccaggcggttttccttggtgtcctcggccagggccttggtcaggtcgctgatgctgttgatctgcggaaattccttggccacgttttccggcagtgccagcgcgtaggtgttgctgaatttcgacggcgagagccagaccaagccttttttcgcgtcgagttctttcacccgggcgtaggactgttcgctgtcgagtttctcgtccacgtggttgtaggccaccagggacacgccggtgtattcccagatcaggtccagttgtccgctttcctgggcactgcgcgccaggttgctgcccaggccacccgtcacacgggcgtcgtaacccttggtgcgcaggtactgggaggtgatttcggcaagcagggtctgctcggtaaacacccgggcgccaatgcgaatcaccggtttttcagcggcttgcgcaatacctgcaaacagcaggacgcagcctaatatcaagcttagttttttcatgtcgattcctttcctggcgttaagacgggcgcaacccgcgttccagccagaggcggctggccatggtcaccaggccgtcaagcagcaatgccagcagcgcggtgcacgcggcgccgagcaacagttgcggctggttgttcagggcgatgccggggaagatcaggctgccgaggctgttggcgccaatcaggaacgccagtggggcggtgccgacgttgatcgccagggccacacgtacaccgccgatgatgatcggcactgcgttgggcagttccacgcgaaacagcacctgacgcggcgtcatgccgatgccggtggcggcttccttgagggaaccctggacgtttttcaagccttcgtaggtgttacgcacgatgggcaggagggaggcgagaaacagcgcgaagatggccgggccgctgccgatgccgaggacgccgagggcgatggccagtacggccaggggagggacggtgttgccgatgttgaagatctgcatgaaacgttctgcacgcccgaccatgttgggtcggctgagcaggataccagcggggatgcccacaatcagggctgccagcatggagactaggacaagaatcaggtgagcttgcaggtaaaacaacaaatcgtcgcggtacagttcgatcgtgttgatgccgatccagtggaccagcagggccaggagcgcgacgacaaccgcgcctcctatcagccctttgccatagcgaatagccacaggcggactcctttttttcttttgtcggcgaacacattctccggcggcaatgccattcctggctgtcggcgaataggttcgcgaaaagcagctcgccgatactggcaatgcagtatgcgatcaagccatgagcgcagcctcgtcaggctaacttgctgatatttcagcccctgttccgagtgcggtagcaggggagtggacgtctcgaccttttaaaaggttccacacttgggcgcatttagccacccccaatgggctcaacggtggtccgtaccccctcgtttgcgctatactcgccgcccttttttgactcacctgccaggcgatttcccatgacccaccaggccgccgaagtcgcgaaacgccgcactttcgccattatttcccaccccgatgccggtaaaaccaccatcaccgaaaagctgttgctgatgggcaaggcgatcgcggtagccggcacggtgaaatcgcgcaaatccgaccgccatgccacatccgactggatggagatggaaaaacaacggggtatttccattaccacgtcggtcatgcaattcccgtatcgcgaccacatggtcaacctgctcgacacccccggccacgaagacttctccgaagatacctaccgcactctgaccgcggtggactcggcgctgatggtcctcgacggcggtaagggtgtcgagccacgtaccattgcgctgatggacgtttgccgcctgcgtgacacgccgatcgtcagcttcatcaacaaactcgaccgtgatatccgcgacccgatcgagttgctggatgaaatcgaagccgtcctgaagatcaaggccgcgccgatcacctggccgattggttgctaccgcgacttcaagggcgtttaccacctggccgacgactacatcattgtctacaccgctggccatggtcacgaacgtaccgaaaccaagatcattgaaaagctcgactcggacgaagcccgcgcccatctgggtgacgagtacgaccgtttcgtcgaccagctggaactggtgcagggcgcctgccacgaattcaaccagcaggaattcctcgacggccagttgaccccagtgttcttcggtaccgccttgggcaacttcggcgtcgaccacgtgctcgacgcggtagtggactgggccccgcgcccgctggcgcgtgtcgcaaacgagcgcaccgtggaaccggtcgaagagaaatttaccggcttcgtgttcaagatccaggcgaacatggaccccaagcaccgcgaccgtatcgccttcatgcgtatctgctccggccgctacgaaaaaggcatgaagatgcgccacgtgcgcaccggcaaggacgtgcgcatcggcgacgccctgacgttcttctcctccgagcgtgaacagctcgaagaagcctacgccggcgacatcatcggcctgcacaaccacggcaccatccagatcggcgacaccttcaccgaaggcgaagcgctgggctttaccggtatcccgcacttcgccccggaactgttccgccgcgtgcgcctgcgcgacccgctcaagtccaagcaactgcgccaaggcttgcagcagttggccgaagaaggcgccacccaggtgttcttccccgagcgcagcaacgacatcatcctcggcgccgtcggtgtgctgcagttcgatgtggtcgccagccgcctgaaagaggaatacaaagtggagtgctcctacgagccgatcaccgtgtattcggcgcgctggattgattgcagcgataagaagaagttggaagagttctccaacaaggccgtggaaaacctggcgatcgacggcggtggtcacctgacctacctggccccgacccgggtcaacctggcgttgatggaagagcgctggccggatgtgaaattccgcgcgacccgcgagcatcattaaaaacaaataatccctatctatgaacagaaggccccgcacgttgatagtgcggggcattttttatttcactgctttttttgtgtctactgtcaatgttgacagtagacacaaaatagggtggcacctaatttataggcggtaactcagtaagtctgaatgttctcagcctgatgcggaggtgtgcaatggaaaatgcaagtaaagctgccagtgggcaggttagttacacggtcggtacaggcacagtcatatatggagtgtctgatatgtatgacggtggcgattctattgtcatcgtgacagggaataccggttcagaagggggaagtatccaattatttttcaatggtggaaaagagttctggctgcgtaacagcccgttgagcggaacattaattgcagaatatattccgcagtgggataacggtcgaaaatggctggggatttccggtaccgtagaggcggtagtgagtgccgagagaaaactggctattgttgcctttacttttatggctcgtcgtaaccaaagttccgaaactgttgaaattaccgggcgtctttattgcaatgcgtttgcttaatgctttagcagaggtgggttgcaataagtagtggattttagctgtttgctttttggtaatatatgggcgggtcttaagtctaatttgtcataagtatttgcggtaagcgcacatccaatttagcgttttgggtgtgccgctcgcccatcggcgaatttggagaaccctatgtttataacgcaacgtgctatccctctaataatgttggcacttctcgggggaacggttgcctgggcgcacgagttgcaagtagcaactgcgttggcacccacctggaaagaaaccggccccgtcaccaagaaaaagcaaagcgaggccagctccggtagctggcagccccaggcccagcctgcacccaaggaagattaggaaaacccctacaacgaaggcgaagacagcgaaacctacgacgacggcaataagtgaagcctggcgaaaacccggcatcgggactagcgtcaacgctggcgacggtgaagcactgccgtgcgggattcatctactgactggacggaatcaaccatgagtatttttcaacgcgtagtgctgttgatgaaggtgctggtgctgttgtcgttggggatgtcgacggcctgggcgcataacccggtgcagagcgtaggggtggtgacgagtggccaggcatcggacttgcagttggccaagtccgaagccgaaccaggcgatcaaggccagggcggcagcgagggtgatgatggctcgactaccgacgagcctgacagcgacgacgcagacgaaggcgacagccagacgtagtcttgctgaaaagagcgcgcctcccgtcaggctatagctggcggaaggcgcttttcagacctcaggcggtgactagaacgaggtggtcaccgacgcgaagtaagcccggcccggctcgttataggtctgtgcaccggcatcctcggcattgcctttgcgcgacaggcgcttgtccagcaggttgttgataccgacacgcacgctcaagtttttgctgaactcataaccactgctcagtcccatcagcccatacgggtcgacatcctgctgggcgctgcggtcatagctgttggcgctgcgtgagttgagtgtcggcgcttcctgcttgccgtagtaggtgccgctgacctggaaggacagcttgtcggtggcttgccagtccagcgtggtgttgacggtgtacttggggatgatgctcaacggctcgccggtgtctttgtccttggagtcgatcatgtaggtcaggttggtgttccagtccagatcgctgcgcaggcttacgaacaggttgccttcaaccccctggaccaacgcgggcccgctgttttcccactccagcacgcggcgaccattgcccaggcggaacgccgcctcgttactggcattgatcttgttcttgtagtcattacggaagtacgtcgcgctggtgcgccaggtgcccttgtcgtaggccaggccgatttctttattgacgctgatttccggtttcaagtcccgattacccaccaggtagcaaccgcccatgttggcttcgctggcgttgcaaccgttgcctcggctgtacagcaaatagttagggttggacctgatacaggttcggggtcttgtacgccctggcaataccgcccttgaggctcagttcatcggtcaactggtgcgaggcgttgaagctggggctccagttgccgccgtattcttcatgatcgtcgtagcgcaggcccggggtgatgatggtcttgctgcccagttcgatgttgtcctcggcaaacaatgcgtagctcgatgcggtggtcttggtgctgttgcggctgaccccaggaatggcggggacgccgccggtgcccgggtcatagctttgcgggcgcaacgagccgggatcgttcatcgattcgtagaggtattcgctgcccagggtcagcacctgttcggtgcccaggctcagtggcaggttgacctcggcggtggcccgggtattgcgcaagcgtgattcgaaacgaccggcgcttgccgaaggcgcaccctcgccggcaccggccaggccttcgttgagacgctcgttgcgggtcaggtcgtgggtcagcgaggccagggtcgagccccagtcaaattcaccacggtgggttgcagagaagctgctgcgttgaatcacactggtttccttgcccaccaggctttcaacgaatgcgccaccgccgttgagcatggtgtcgccggcaaaaatattaccctggcggctatagctggcttccaggtcgagggtctgctctggggtgaattgccagctcagcaagccattgacgtctttattgcgtacgccttcgcggccagcgaccaaagaatcaggcgtcgcttgggctgcgcggttgatgtcggcgtcatcggcgtcggtcttgttcaggccgccatagacgcggaatgcgagactgtcggtcagcgggccgctgagattgaagttggtacgtttgctcgcgccttcggcgtcattttcggggaaggcggtgtaggcggtcagcgaaccgtgcaattggtcggtcgggcgtttggtgatgatgttgatcaccccgcccatggccccggagccataacgagcggcggccgggccgcgcaggatttcaatgcgctcgacttcttcggccggcacccagttggtttcgccacgggtatcacggtcaccgctccagccataacgcacggcgttgcgtgaggtggagggtttgccatcgatcaggatcagggtgttttccgggcccatgccgcgcaggtcgatctgacggttattaccgcggctgccgctggagctgttgccagtcaggttgacgcctggctcgcggcggatgatctccgacaggtcgttggtgggcgggcgcttcttgatgtcctcggcggtgatgatcgatacgccaggggcttgcttgagttcttcggcagcggtgcctagtactcgcgtttcttccagcaccaaggcttgaggttggccgtctacaggcaggtctgtcgcttcgatcggcactttatcgcgctgtttttccacactctccgccaacagcgcgggggacgaaagggtagcgataaacgccagcgatagatggctgagcctgaattgagacgacatgtccacaaagtcctttacgaggggcgattgaacgagaggcgtctgaatttttcgcgtagccaaccgtggcttggcagccagtatccagcgccctctttgtgtcgtgatggtattgattctcaaataaaagtaaattgcatttacaatctatacactttccagagggctctgacgcaatgttttcaaggccggaggcattgaaaggcgcagggccatctgtattttctttgctacaaacgcgcaaaaaaaagcccctccggccagactgatgcgcaatctggcgggaagggcgatggaactcattgaagccgcagcccctgtaggagcgagcttgctcgcgaagaccgcatgcacaccgcgttaaatcagaatgcgcgcgttatcgttgacgtctttcgcgagcaagctcgctcctacagtgggaggctgtgttgcttcaggccacgaattgctccgcgtagtggcaagccacctgccggttatccaatggtcgcaacagcggctcctcgctgctgcagcgctcggtcgcatacgggcagcgcttgtggaacgcgcacccaggtggcgggttcagcgggttgggcagttcgccgacgattttgatcttcggcttgttcgggtccgggtggatggtcggggtggccgacagcagcgcctgggtgtaggggtgcagggggcgtgcatagatgtcttccttggggcccacttccaccgggcggccgaggtacatcaccatcacatcgtcagcaacgtgctgcaccactgccaggttgtgggagatgaacacgtaggcagtgttgaactcctgctgcaggtccatgaacaggttgagcacctgggcctggatcgacacgtccagcgccgaggtcggctcatccgccaccagcactttgggttgcagcatcattgcccgggccagggcgatacgctggcgctggccgccggagaacatgtgcgggtagcgctgataatgctcggggcgcaggcccacttgcttcatcatcgcctggactttttcgcggcgctcggcggcggacaggttggtgttgatcagcaacggctccgccagttgatcaccgactttctggcgtgggttcaacgacgcatacgggctttggaacaccatctgcacgtctttacgcaattgcttgcgctgggccttgtcggcaccggccacttcctgaccggcaattttcaaggagcccgaggacggctcttcaatcaacgtaagggcacgggccagtgtggatttgccgcaacccgattcgcccacaaccgcgagggtcttgccggcttccagctcgaaggacacaccattgagggcacgcacggtggcgtggcccttgaacaggccacgggacacttcgtagtgacgggtgaggtcgcgggcggtaagaacgacggccattacgccacctcctggttcaaggggtagaagcagcgcgcaaggctgttggttttcggatcaaggctcgggcgctgggtgcggcagttttcctgcacgtacgggcaacgtggcgacagcaggcaaccctgcgggcggtcatagcggcccggcacgatgcccggcagcgtggctaggcgcgtggcgcccaggctgtgttcaggaatcgccttgagcaatgcttcgctgtagggatgcgccggaatatcgaacaactgcggcacctggccaacttccacggcctggccggcatacatcacgcacacgcgctgggcggtttcggccacgacagcaaggtcgtgggtgatcagcaccaggcccatgttctgttctttctgcagggccagcagcagttccatgatctgcgcctggatggttacgtccaatgcggtggtcggttcatcggcaattagcagtttcggctcgccggcaattgccatggcgattgccacgcgctggctcataccgccggacaactggtgcgggtaggcatccatgcggctggcggcgcccgggatttcgactttttccagcagctcgatggcacgcttgcgcgcttgcttgccggacattttcaaatgcaggcgcagcacttcttcgatctggaaacccacggtgtagctggggttcagcgcggtcatcgggtcttggaacaccatcgccaggtctttgccgacgatctggcggcgctggcggttgctcagcttgagcatgtccttgccgtcgaagttcagggcgtcggcggtgacaataccggggtgctcgatcaggcccatcagcgccatcatggtcacggatttacccgaacccgactcgccaacaatcgccagtacttcgcctttgtcgacggagatgtcgaggccatcgaccaccggcacagcggtcttatcgccgaagcgtacgttgagattcttgatttctaacagtgacatgggaatctcctcaggcggcgttcttgagtttcgggtccagcgcgtcgcgcaggccgtcacccatcaagttgattgccagcacgctgagcaaaatggtcaaaccaggcaggctcacgacccaccaggcgcgttcgatgtagtcccgagccgaggccagcatggtgccccactccggggttggcggttgtacgccaaggccgaggaagcccagggcggcggcatcgaggatcgccgacgagaagctcagggtggcctggacgatcagcggcgccatgcagttaggcagcacggtgatgaacatcaggcgtggcaggccggcgccggcaaggcgggcggcggtcacgtagtcgcggttcagttcgcccattaccgccgcgcgggtcagacgtacgtaggacggcaacgacacgatagcaatggcgattacggtgttgatcaggccagggccgaggatggcgacaatcgccacggccaacagcagcgatggcagggccagcatgatgtccatcaggcgcatgatggtcgggccaagcaagcgcgggaagaacccggcgaacaggcccagcaggatgcccgggatcagcgacatcaccactgacgacaagccgatcagcaacgacaggcgcgaaccctggatcaggcgcgagagcaggtcacggcccagttcgtcggtgccgagcaggaactgcatctgcccaccttccagccaggctggcggggtcagaaggaagtcgcggtattgctcgctggggttatgcggtgcaacccacggggcaaaaatcgcgcagaacacgatcagcagcatgaacagtaggccggcaaccgcgcctttgttcttggagaaggcttgccagaattctttgtacggggacgggtacagcaggctctgatcgactgctgacacttgagtaggtgtggtcatggtcatgatctcagcgctggtgacggatgcgtgggttggcgaagccgtagaggatatccaccacgaagttcaccaggatcaccaggcaggcgatcagcagaatgccgttttgcaccaccgggtagtcccgtgcgccaatggcttcgatcagccatttgccgatgccgggccacgagaagatggtttcggtcagtaccgcaccggccagcagcgtgccgacttgcaggccgaccacggtaagtaccggaatcagcgcgttgcgcaggccgtgcacgaatactacgcgtgccggcgagaggcccttggccttggcggtacggatgtagtcctcacgcagaacttcgagcatcgacgaacgggtcatccgcgcgatcaccgccagcgggatggtgcccagcacgatggccggcaggatcaggtggtgcagggcgtcccagaacgcgtccggctcgtcggccagcagggtgtcgatcagcatgaagccagtgcgcggctcgatgtcgtagagcaggtcgatacgcccggaaaccggggtccagcccaggcttaccgagaagaacatgatcaggatcaggccccaccagaagatcggcatcgaatagcccgccagggagatgcccatcaccccgtggtcgaacagggatcctcgtttcaaggccgcgatcaccccggctaacagccctaggatgccggcgaacaacagggcggccatggacagttccagggtcgcagggaaaagggcggtgaactcggtccacacgctggtgcgggtgcgcagcgattcgccaaggtcgccctgggcgagcttgccgacgtaatccaggtattgcgcatacagcggcttgttaaggccaaggcgctccattgcctgagcgtgcatttcggggtcaacccgccgctcgcccatcatgacttctacggggtcgcctggaatcatgcgaatcaacgcaaaggtcagcaacgtgatgccgaagaacgtggggatcaataaccccagtcggcgggcaataaaactaaacatcttggtgtgtacctcaatcagccggttaggcaggttcggcaccgtcaatatcgacggcgccgagcgtttttcttatttacttcacctgggtggtggcgaagttattgttcgtcagcgggctttgggtataaccctcgacgttcttgcgcatggcggtaaacatttttggataagccatgggtatccacggctggtccttctcgaaaacatccagggcttgttcatagagtgcggcccgttgctggggttcagcgatggcgcgcgccttgtcgatcaagtcctgaaactccttgttacaccaacgggcgtagttttcgccgtttttcgctgcatcgcaacttaggttgggggtcaggaagttgtccgggtcgccgttatccccggcccagccggcggaaaccatatcgtgctcaccgtttttagcacgcttgagcatctcgccccattccataactttgatgttgaccttcaggccaatctgagccaaatccgcctgcatgcgctgggcgccaagcatcgggttagggttggtcgggccgccgccgttacgggtgaacagactgaactcggtgccttccggcacgccggcttccttgagcagggcgcgggctttgtcgaggtcgcgaggtggattcttgagcttgtcgttgaagcccagcagggtcggtggatacggaccggtgccgaccactgcattgcctttgccgtacaaggcatcggtgtagcctgccttgtcgaacgcaatgttgatcgcgtgacgtacccgtgggtcgctcatgtacttgcgggtagtgttcagggcggtgtagctggtagtcatggccgccagctcatcgactttcaggttcggatctttcttgatgctcggcagatcatccggcttgggataaagcgcgatttgacattcattggccttgagcttttgcaagcgcacgttgttatcgaccgcaatggccaggatcaacgggtcggcgggcggcttgccacggaagtattccgggttggccttgaagcgcacctgagcgtctttctgatagcggatgaaaatgaacgggccggtgccgatcggcttgctgttgagttcgtcggtcttgccggcggcgagcagcttgtcggcgtactcggcggagtggatagcggtgaacggcattgcgacatcggccaggaacggtgcttcagggcgcgtcagggtgaagacgacggtgtggtcgtcaaccttctcgacactcttgagcagttccttgaaacccatgctttcaaaataagggaaaccggtggtggacttgttatgccacgggtgtttcgggtccaactggcgctggaagctccacagcacatcgtcggcattcaagttgcgcgtgggcttgaagtaatcggtcgtgtggaacttgacgtcttcgcgcaggtggaacgtgtaggtcaggccgtcatcactgatttcccaggacttggccagcgcgggaaccacctcggtcgtacccggcttgaaatccactagacggttgaacatggtttcagcagcggcatcagcggttacggcggtggtgtacagcaccgggtcgaaaccttccgggctggcttcggtgcagaccaccagcggtttggccgaaacgccgattgccacgctcaacagcgcggcagccatggcggcttgtagtgggagcattttcattcagagccctctgcaatcgatggaaccagaaaagcgtagacggcgaggctcgtcctgagcccgccgtctacctggcgctaattaaaggatgttgaatgggatggtggtaaccagacggaattccttgatgctgccatcggactggaactcgctgccacggtgttcaacgtaggtggcgcgaatcgcggtggccttgagcgggccactctgcaccgcgtaggaagcgcctacaccgtattcctggtgcttctcgccgtcctgggactggatgccgtcgtaggcgaacttggcgcggccattgttgccggtgtagtgggtaccgtcgatgccccagccgcgggccgagtaggcattgaacttcaggcctggtacgccgtattcagccatgttgatggcataggcgatctggaaggatttctcgttcgggccgttgaagtccgaggtcagggagttggccaggtagatgccgttggtttcgtgcaggtagtcgaagtactcgttaccgttcacttgctggtaaccgaaggtcaggctgtgtgcctggtgagtcaggcccagggacagggagaaggtatcgttgtcgatttcccccatctcttttttgccttcgtcgacagtcttgtagtagttgaagccggtggtcaggcccagttgctgagcgtcgcccaattcatgggtagcgccgaagtagtactggttccagaagtccttcacgttggcggcgaagaagctggtcttcaggcttttcagcggctggtagttcacgcccagggtggacactttgtcggtttctgcgccattgccgtattcggtacggaatttcgacaggctctgctcgctacgtggcgaaacgcggtcaaacacgccgccctggaacgacaggttgctgaactcttcgctgttgaagctcacaccctggaagcttgaaggcagggcacggttgccgatggtgtcgacgatgccgctgctgaagttctggcgaccggcggtcaaggtggtgttggacacgcggaactgcacgttggccaggcccagcttgctccactggtcgacggcgtcgccgttggagtccgccagggtacggttggagccacccttgatgtcacgcttgctgcggtccagtaccagggcgttgtagaccgctacttcggtcttgaccccaacggtgccctgggtgaaacccgagctggcgttgaggatggtgccctgcacccagttggtacggttgcgatcagtcagcgtctggccgtgtttctggtaggcgaaggtgcccccacggtatttgctttcatgggagtaccagttacgcgtggtgccgcccaggctgaaatcttcaatgaagcccttggcctcgccttgggcgctggtgctggccaatgtggtaggaacgaagtcctggctggcgggttcagcataggcggtcgccgtgatgctgctgatggccagggccagaagcgctttgctgctcagtttcatgggtgaagctcctttggttctcttttttatgccggtctttttaggtgaaccggctattgggtgtggaactcgttcaagcctttgcaaacgtttggcgtaggaattttcctgacaaaagcctgcacgtttgccgaggagccgacttggctccccgcaatccggttattttcttatggggtaatgctgacgcccgagaacacgttgcggccgaaggggctcaccttgaaaccttcgactttggcgcttaacggctggttgaccgtcgagtgggcgatgggcgtgatcggcacctgctgcttgagcagttgctgcgcctgtttgtacagaacagtcctttgttcgcggtcggtcacgaccttggcttgcttgatcagcttgtcgtacgccgggtcacaccacatggagtagttgttcccgccgatggcgtcgcagctgtagagggtaccgagccagttgtccgggtcaccgttgtcgccggtccagccgatcaggctgacatcgtgctcaccgttcttggtgcgcttgatgtattcgccccattcgtagctgacgatcttgaccttgaggccgatcttggcccagtcgttctgcagcatctcggccatcagcttggcgttggggttgtaggggcgctgcaccggcatggcccacagggtgatctcggtgccttccttgacgccggcagccttgagcaattccttggctttttccgggttgtaggcggcgtccttgatgctgtcgtcataagaccactgcgtcggcggcatgccattgactgccagttgcccggcgccctggtacacggcgttaaggatgctctgcttgttcaccgccatgtccagcgcctggcgcacttcaagctgatcgaagggcttgtggcgcacgttgtaggagatatagccgaggttgaagccgggtttggtcagcagttgcaggttcgggtcagtcttgagcgcttcgacatcggcggggcgtggatgcagggtgacctggcattcgccggccttgagcttctgtacccgcaccgaggcatcggtattgatggcaaagatcaattggtccagcttgacccggctcgggtcccagtactgtttgttgcctacataacggatctgcgagtctttctggtagcgctggaacacgaaagggccagtgccgatcggcttctggttgatgtcgctgggccgtccttgtttgagtagctgttcggcgtattcggccgagaggatggcggcaaagctcatggcaatgttctgcacgaacgcggcgtcgaccgtgttcaaggtcatcaccacggtgtaggggccggttttttcgaccttggcaatattcttgttcaggctcatcccgttgaagtacggaaactccgtggggtaggccttacggaacgggtggtcgggatcaagcatgcggttgaaggtaaacagcacgtcgtcggcgttgaagtcccgcgtcggcttgaattccttgttgctgtgaaacttcaccccttcacgcagatgaaacgtataggtcagcccgtcttcggagatatcccacttggttgccagccctggcaccacgtcggtggcgcctttttcgaactcgaccaggcggttgtacaacggctctgcggcatcgttgtcggtggcggtggtgtattgcgcagtatcaaagcctgccgggctgccttcggagcagaacaccaggctcttcttctcggcggcttggcccatggtggccacggccagcaggctggaggcaaacatcgcggatagaacggtggtatggcgcatgacaatcccgatccttgtttgtagttatcaacagcgaaccacctctctggcgtacggccagggagacatcactgatcccacacacagcaagtgccctttcccagaatgatgcctctgctgtcctacgacgttatggggcgcggacactgcagtaaatgcgtcaattctgactggccttgtaggtaacggagacacgggacgcagttcgttgctgtaggacggcaacgctttcaatcgtggtctgtttcctatagcccgggcagatggaataacggcgacgttatgaaacgtcgccgctattgatccttacttgccgctgacgctaacgccgtagaaggagttcaagccaaacgggctgatcttgaagtcctgtacggtattacgcatgggttgatacaccgtcgagtgcgcgataggtgtcatcgggactgcatctttgaggatatgttgcgcctgcttgtacagctcggtgcgtttggcgacatccgacgtggctttggcctcttttacgatgccgtcgaattttttgtcgcaccacttggagaagttgttaccagacagcgagtcgcagccgaacagtacgttcagccagttgtccgggtcaccattgtcgccgctccagccaatgatcatggcctggttctcgccgcctttggagcgcttgatgtactcgccccactcgtagctggtgatcttgaccttcaggccgatcttggaccagtcgttctgcagcatctcggccatcagcttggcgttcgggttgtacggacgctggaccggcatggcccacaggacgatttcagtgccttccttgacgccagcttccttgagcagcgccttggctttttcagggtcgtacttggcgtctttgatgctggtgtcgtaggaccattgggtcggcggcatggcgttgacggccagttggccggcgccctggtacacggagtcaatgatctgctgcttgttcaccgccatgtccagcgcctggcgtacgcgcaggtcagccagcgggtttggctggtcgctgcccttgaccttgtccattacgttgtaggcaacgtagcccaggttgaaaccggcctggtgcggcagtttcaggtccttgtcttcgcccagggccttgaggtcggccggacgcgggaacagggtgatctggcattcgtttttcttgagcttctggatacgcaccgatgggtcagtggtgattgcgaagatcaggttgtcgatcttcacatcttcaggtttccagtagtccttgttgccggtgtagcgaatgttcgaatctttctggtagctcttgaacacgaacgggccagtgccgaccggcttctggttgatgtcggcgggcttgccttccttgagcagctgcgcggcatattcggcggattggatcgacgcgaagctcatggccaggttctggatgaaagccgcgtccacggtgccaagggtgaacttgacggtgtggtcatcgactttctcgatgttcttgatgttggtgtccatccccatgtccgtgaagtacgggaactcggtggggtaggccttacggaatggatcgtctttgttgatcatccgattaaaagtgaacagtacgtcgtctgccgagaattcacgagtcggcttgaagtacggggtggtgtggaacttgacgccttcgcgcaggtggaaggtatacgtcaggccatccggggacacgtcccagctggtggccaggccaggaaccacggcggtgccgccacgttcgaactggctcaggcggttgaacatggtttcggccgaggcatcgaagtctgttccggtggtgtactggcctgggtcgaaaccggccgggctcccttcggagcagaacaccaggttagttgccgcaagggctgcaggggcggcggccataaggcccgcgctcactaataacggaaggactgcgtgtttaagcatgttggcctcatgatttgttgtcatttttggtggtgagggcgacctcgtgagtcggcctgcggatacttatgcaggcgccatacccaatgcaagatgcagagcggccaggagcggcaaacagtggtacgaacgtacaggaatgtcgcaattatgaaagtttcgacacaaatatgcctgtttggagggttttttcggtgcaacaggtgcaccaaaaaagcccagccgaggcgtctagcgcactcggttggggcgctgttgttacttatctagacccacaccatagaacggcgtgagcccgaaggggctgatcttgaagtcgcgtacttccttgcgcaaaggctggaaaaccgtcgagttcgcaataggcgttataggtacttgttccttaaggatttgttgtgcctgttgataccacttgatgcgctgctcgcggtcgttgctgaccttggcctgctgcaccagtttgtcgtaggccgggttacaccatttggcgtagttgctgcccttgaccgcggcacaactgtagagcacgcctagccagttatccgggtcgccattgtcgccagtccagccataaatcatcgcatcgtgttcaccattcttggcgcgttttatgtactcgccccactcatagctgacgatgttggccttgatgccgaccttggcccaatcctgttggatcatttgcgcggacattcgcgcattcgggttggaggcgcgctgcacggtcatcgcccaaagattgatggtggtacctggtgcaacccctgcttcttttagtagcaaccgcgccttggacggatcgtagggcgcgtcttggattttcgggtcataagaccactgcgccggtggcaatgcgttctgcgccaattgtccggcgctctggtacacggccttgatgatcgcaggcttgtcgatggccatgtccagggcctggcgcaccttgagctggtccaacggcgggtgggtcacgttgtaggccaggaagcccaggttgaatccggcttgctgcagcacgcgcaggttggggtcttgcttcatcacctcgatatcggcggggcgtgggtaaccgctgacctggcattcgccggccttgagcttctgcaggcgcgcggcggcgtccggggtgatggcgaacaccagattgtcgagcttcacgtcctcgggtttccaatactgtttattggccccatagcgaatctgcgagtctttctgataacgcttgaacacaaatggcccggtgccgaccggtttctgattgatctgctcgggcttgccttctttcaggagctgcgcggcatattcagtcgattgcaccgaggcaaaactcatcgccaggttctgcacgaacgaggcatccacattgttgaggttgaaacgcacggtgtgttcgtcgagtttttcgaggtttttgattgtggtgttcaatcccatgtcagtgaagtacggcgactcggacgggtaggccttgcgaaacggactatcggcatcgagcaggcggttgaaggtgaacaacacatcatcggcgttgaagtcgcgggtcggggtgaagaaatcggtggtgtggaacttgacgccctcgcgcaggtggaaggtgtaggtcaggccgtctttggatatgtcccaactggttgccaggccgggttcgacttcggtgcctccacgcttgaactgggtcagacggttgaacacggtttcggcggatgcatcgaagtcagtgccgctggtgtactggctgggatcgaagccggcggggctggcttcggagcagtagaccagggttgtggcggcctgggccattggtataaaggccaggaggctggcggcgaggaacagtggcttgacggcgattctttccatggagacccctgaaatggcaggcatataaaagctgcccaaacgaaaacggcggtcatcgaggttaccgccgttcaagcgagttaggtaggggagacttctatgcgggtaggcgcagatttgtcgattataacgggcggtccatccactgcattactctcacgaagggtgaacgtccggctggctgtgatgctcaagtctgaggcgggaatgggctcatctccgcctgcataaacgagtttccattgcgaggtcaccgtgactttggtctcattttccaaaggcgaatagtcgatgaaaaagtgtcggtcgccagcgctgctcacgtagtcgtcttttactcgggggggctgcaattcacgccacgccgtagcggccgagccttgatgcgctacctctgaaatcgccgcccgcatgtcggggtcggggaccgcattttcaaaggtttcgattccgtcatggataaaaccatcgacgactgactgctctgcattattgcccggaatatgaagttcttctatctgctggggtatgttgatttcaacgtcctgcaagcccggtcgccttattgtgtaagggtttctgttgatatctgtggtgaattggccagcgtagttgctggtgccgaactttgaaggggatgccgcttccgaagcggagaccgtgaagtttctatcgtctacttcccatgaaagcacagggcgacttttaaccgtaccgttttcctcataaacgctgacgccaaatctatactgcgtctgctcctcaaagttgaggtatttgtcgagtgtgtcggcgccctccatttttgatccgtctaactcaataaagttgtccgaaaagcgggagggtgactttaagtcgttactcggggccggcgaaatcggacgttgccacggccacttcaccccgccatcgccaggtgcgcgagcccactctccgtcacgccctggcgtgatgaccatcactgctgattgtttatcgggattaatgatggtggcgaacctgtcgccggtcctgtagcgaccggatatctcgaataccttgctcgtaccggtctcatcggtaaaccgcacaaattggcgctgtattccctcactgtcggttattcgatagacgcccagtgcatcgcggggagcattcattatcaattcatcaccgtcaggtactgcatggggtgccattgggagcagtggttgtgattttggcagggcagccccaggctcgttgacaacgcgtatgccactggatggcccgggtgtgggttcctcggtggcattgatttcgggttgaacacggggctctacattcggcagttctttctcaggcggtagcgcaaaaggatcctccgggactgcgcttgccccggctgagaacagcgtattcagcaaaccatcgaatgccttggacaccccatcgctgcgctctgcctcggtgtcaccggacgctgctttttctgcgcccaaccccagctcggtcaaccctgcaagtgccgcagcgcccgcaaccggagctgcgatgggcgcaagcttggccagcagacccgcagccacggttatgtcgttcagccaggtgtcgcgagtcacttcgctgttggatttgatgaccacgtcggtatcgttggtcatgcgttgtttcgcggcggtcgccaatgtggaaaatacgtctccctcgatttttgcgcggctgtcattgagcaccggggtattcagatcaccggcagccatttttttgaacaggccgtccaggccatcttgcttgtcgcctattcccgtaaagttcaagccagggataaggccgattcccagttgcggcaggatgccgggcttatggtcctggcgatcaatcaatgaaaaatgtgccagcagcgcctggctttttttcggatcctgactttgctcaaccacccactgattgagtttttccagggagtcgaagcgcaggaatgccggctttgctcccggtatataaagtacctggcgacctccatcgtcatcgctgaaccgcacaatgtcgctggacttaaaaccgtggatgctaagggcatgcacttgagtgtcgccgtttaccggcgcttgtgccttgagctgctccatgctcaacgcagcgttctcgtcgagcgggaggttgccggcagccgccatcaccaagcggtagtcacctcgattgaatcgatgctcgggtgcttgtaaggctcgctcggcgggtgatcgggcttcggccgtcttcaattgttcgcgggcctggaagacgaactcgcctttaattgcagtctggtagccgtcggtatgggtgttccagaaggtgtcgattttctgggtcatctgggcctggaagtcggtcttccagctttcgtgcatcacttgcgacggcttaaggtcgatttgattatgcttgccgtagccgcctttttcgctttgcccactgggttgggtatacagacccgcgtcgagatccaggtttccgggtacccagtcgtgctcggagaaattcttcagcaaggcatcgggcaggcgcagcgaagaccagggttcttggaacttgtgctcccagccggtcacagtatctgcgctttcgccgcccttgaagcggttcaaataaacggtatctgaatcgatcggtttgcccgtgagcttgagcagcaactcgtccgcccatttcttggcttctgcccgtgtgtcgggcaggttggtggcaacgtcgaccgccaagcgcttgtaggccaatgcctgcggcgcggtgctgtagtacgtggccgcattttgtctttgcacttgcagcgcatttgccgagcggctgctggcaggacgcaagtgatcatcggcggaaataggatcgaaggtgtctttatgctccaggtgccttatttgtgctcgggcctgggacaacgttgggggaagtgccaccccttcaaaatttgctactacttttgcgctgacttgtatggagttttcacccagcctcacgcgcaaatcaccattattgcctggggcgatgatcctggcggccgccaacagaggccccgaaatttgtccccagcccgatgtgtccgtgaggcggaaggttttcgtttcgcccctcacctcggcggacaacgtacctgtagacgggttgattgagaggagagtgttcggttcgatctgctgttcgcgcagccaaccctgcacaacagggtgttccaaatgtgcgcgatacagtccaagccattgacccaggttgctctggggcgggaccgtgataagcccggcattgttgtgcaataccttgcgttgcacagcctcaaggtaagccttgagcagttccgtttcggcgggctgggccgggtttccaatggacgtttgaggcgcttgtgaggtttgtgcttcagttatcgactttggggcgccgagtaccgacgccagcgatacgggcgatgttgcattgactgatagggacataagtttggctctcactgtatgaataaatgccagcacagccctccctggtagctatggcagtattgagtcgtgaagaccttgaacgtaattccagcgagatatgctgctggatatgacgtggcggcagcgaacgcaaaaaaaagcgcaagcccttgggtttgcgcctttgtcttgtctaaaaaagttactgtaaaacttcgatcacgccatctgcactcatattgacctggcgggcctggctcagggcctggttcatggtggtggggggcggcagcgagcttggtcgggtcggcattttgcaactcggtgtagagggtcatgatcgtcttgtcgcgagccacttcctggctgccgtcagcgcgcagcgatacctgattgtaatatcagtgcatcggcggccatggccgggaggctggcaattgcactggcgctgagggcgatttgacgactactctttcgatggcgagcatattctcggtgttacggttttgggaaggtctcgggtttataagtaaacgcccaccacttcaacggattccaatagggatttttctttgccggtttgaagtttgtttttttcgccagttctttggcggcgtatttttcagcttcggatctagccaatgccctatcggcggcagtcaggggggtggcctgatttttttccagggcttccaaataagcactttctacttttacaaccgctgcatttacatcttctggtgtgaggttagcgctgagggtgccactatagcctttgaccgggcgccctatgagcttctgaaattcagctgcgaaggaggcatctccaccacttgcagagtcacatgagagcagtcttacattggcaaacgtctcggggtgaataccttcgttgtgaagtgtctgaagtaactcttgtggcgtattgagttttccattatatgaaactttcgagatgccagtatcagggtcgacactgccgtgtaccagtatgttgagtcgttcttgagtgccttttttgttgaaatcggtaaatgtgtagagtttttcgttaagggtgtttagctcattgagttctccactcaggattacgtttttttcaagcgtggaaaaaagatcttcgccggtgggtaagttctctatggaatttagaaaatcacgtttactatttggtggttcgattgtcggatgggcaccttccgtttcactggcgtgtggcgtactcggttcgtttgacgcggtgttggagacgggggttatatcgctttcattggaggcgtttacttttttcacgaaatcaaaacggttggcctgctcattgtatctccagccgtaatgttggctgtcggcggtgttgaaactcaaggccggttcacccagtcctgcctctaccccagccggtataatttcatgcgccagcagcaggcctgatatcactaccccggccctgcctccaacgcgatcgctggccgtcatgccatgggcggcgtcatgcttgccgaaaacaatattgcccgcgttgccaaggacgggtacgtagccaaaggtatcgccccatacttcttttgcggccttccagccttgctccatggcgccaaaaaccttggtttgatcgtcccatagcgcgttcttggcgttcatctcgtgataatgcgaggcaatacccttattcagattgccaaatttcagttcatagtcaccgcctcgcgattgggtataattaaacaattcccgaacgggtacggacttgtcgcttaccaacgtgtcccgccctgggtagtgggatgtattatccaggatcagactgtcgagtacggtcgcggccggtggccaatgcgcgtcccttcctccttgtaggtcactggcattgaaacggcttatcagttggttacgattgtctttggcccacgccgcaaactcgtcatcgccctttatctcgctgacagcaccacttctcaaatcaagcatgacaccctgattgggccggttgttgtaattgccattatagggcgtatagggaatgaacgcgtacccactcagggggtaaccgtagatattgggaataatcacttgcccattcttatccagcgtgcggctaatcgcttcttgaccggaagagcttaacttttcaaaggcctccttatcgctatgaagactctgcaaagcgccccgcgcgacataggcgtctgctttgcccgagcgttcaggtattactgttgatattttgggtctaggtaggaatgggaggtggggtatgagaggaaagtcatccgtaatctcaataagggtgttgaccctggcgctgccacgcattggcgtggctatatcctgctcccagtggttttgaagttgtttgcctaacgattgcagatcattaatcttgctccggtcttttggatcaatgaccattccatggaaattgacaatcccgccccgtgcgggtttgtcgtgatcaagcacacccgctgcgatttcccatgcagagtaggtacgggtttcggtatcggacagattttctccggtccccataccgacgtaagtgtcgaacgtcacagtgattttttcatgcggatcgaaccctgcagctaatagacccccactgaagtaaccggaaggttccatgaacaggcgaacgttctggaacttaatgtttctctcgccgtcactgccactttcgatattttttatctgcgtatttacacgcgtggcgtaggcatcaatgcgatcttcgcgctgctttaacgtatatctgtttccgggcgcttggacagggtctgagccataaatgattgccttgtagtcatcggagtggcgctgggccgtagagatagtgttgtcggctgtataggcttcgttattattaagcgacacatccggtttctgttcctgcgcctgggtgcgttcagtagacccaggtgccggataacggataatagtaaactgatttaagttttccacttttgattacctggttgggatgatgaagtgatttagtgtgaagtgtgtggctgcttacacaggaaagttccacatcctaatcagacagtgtgagtctggtactttgtttatataagcttcaggtgtacgacgcctgttaaggcgttgccagacgacttaagttgcggtgacgctgaaacagtgtgcaaaaaaaatggcgcaggctgttaaggctgcgccattgtctttttttaatgtttattgctgtacttcaatcacgccatcggcactcatgttgacctggctggtaccggcttccacttcaggtgttggcgccgaatcggccatggccgctttcatcatcatcccgccacgggcataaggcattggatagccgttggtgttgaagttcagattgacgatcttgtaacccttgccacccaatgcgtcagtcgccagctgggcacgagccttgaacgcggcaactgcatccttgagcagcgcatcttcgctggccttgcgcgtagcgtcggcgatggcgaagtccatgttttccattttcagcgtgttcagcagttcgccggtgagcttggacaacgccgggaagtccgcgctttccaggcgcagttcggcgcgttcacgccagccggtgatcttctggttcttgttgtcgtagatcgggtagctgttgcggctgccctggcgcagggtcacgcctttgacctcgcgggcctggcccagggcctggttcatggtggtggtgatttcggcagcgagcttggccgggtcggcattttgcgactcggtatagagggtgacgatcatcttgtcgcgggccacttcctggctgacttcggcgcgcagggaaatctggttgtaatgcagttcatcggcggccatggcctggaagctggccagggcactggcgctcagggtgaggacagcggcactgcgagtgaaacgagacatggaagctccttgagatagtcgtgtcggtatgactgtagacgctggcatcgggttcttcgggtttacacaatagctacaagttatggcaggcccgacgaacggtcatttttttcgccctgcgtcaaagagccacacacgccgtgccagccggcctgcttcgtttatactcgtgccgatccgcctgcagcgctcatcgggagagctcatgctcgccgccgtaaaactgacttccgccactcgccagaacctctggcgcctgacgttcattcgcaccctggtattggccgcacaggccggttccgtcgggcttgcctattggttcgacctgctaccgctgccgtggctgcaattggctgtgaccctaggcttttcctccgtgctctgtgctttcactgctatccggctgcgcaccacctggccggtcaccgagctggagtacgcactgcaactggcctgcgacctgtttatccacagtgtgttgctgtatttctccggcggctccaccaatccgtttgtttcttattaccttgtgccgttgaccattgccgctgtgaccttgccatggcgctactcggtggtgctttcgggcattgccctgacgctctataccttgctgctggcgcagttctatccgttgcaaacctttccgattgcccgggaaaacctgcagatctacgggatgtggttgagtttcgccctatcggccgcggtcatcaccttcttcgccgcacgcatggccgaagagctgcgccgccaggaagaactgcgcgccattcgccgtgaggagggcttgcgtgatcagcagttgctggccgtcgccacccaggcggccggcgccgcccatgagctgggcacgccgctggcaaccatgagcgtattgctcaaagagatgacccaggaccatcacgacccggccctgcaggatgacctcagtgtgctgcaggaacaggtcaagcagtgcaagctgacgctgcagcaactggtgcgcgccgccgaggccaatcgccgcctggcggtcgaaatgcaggatgtgacccactggctcgacgaagccttgaaccgttggcacctgatgcgtcccgaggccagttaccgtttcaatctgctgggccaaggcagcgtgccgcgcatggcgccaccgccggacctgacccaggcgttgcttaatcttttgaataacgccgccgacgcttgccccgaaggattgggcgtgcagttggactgggacgcagaaaacatcaccatcagcattcgtgatcacggcgcgggcgtgccgctggccattgccgagcagatcggcaaaccattctttaccaccaagggcaaaggcttcggcctgggcctgtttttgagcaaggccagcgtgacccgcgcgggcggctcagtgaagctctatagtcatgaggaaggcggcacgctcaccgagctgcgcctgccccgtgtcgcacgaggagatatcgatgagtgacgagatccaagtcgaaggcgaagaactgccgcacctgttgctggtagatgacgatgcgacctttacccgcgtgatggcacgcgccatgagccggcgcggttttcgcgtcagcacagcaggctccgccgaagagggcttgaccatcgcccaggccgacctgccggactatgccgccctcgacctgaaaatggacggcgactccggcctggtgctgctgccgaggctgctggaactcgacccggaaatgcgcgtggtgattctcaccggttactccagcatcgccaccgccgtcgaggcgatcaagcgcggcgcctgcaactacctgtgcaagccggcggacgccgacgacgtgctggctgcactgctttccgagcacgccgacctcgacaccctggtaccggaaaacccgatgtcggtggaccgcctgcagtgggagcacatccagcgcgtgctcaccgagcacgaaggcaatatttccgccacagcccgggccctgggcatgcaccgtcgtaccttgcagcgcaagctacagaagcgcccggtacgacgctgaacgaacactgaacaacctgcttcaggctgcacggatgcgcgaaccgatcacctatgatcggttcaaacgcctgtgatgtttttcctgccgagcctgaacaatgaaccagaacgctgagtactccgcggtcaacgacgcggtgcgggggcaattcttccgccgaacctgggccatgatcacaccgtattggcgtagcgaagagaagggcagggcctggctgttgctggctgcggtgattggcctgtcgctgttcagcgtggcgatctccgtatggatcaaccactggtacaaggacttctacaacgctctggagaagaaggacaccgctgccttctggcaactgatcggttatttcggcggtattgcggcggtggcgattctcggcgcggtctaccgtctctacctgacccagatgctgaccatccgttggcgcgcctggctcaccgaaaagcacttcacccgttggcttgcgcacaagaactactaccaactggaacagggcggctataccgataacccggaccagcggatttccgaagacctgaataacttcacctccggcaccttgagccttggcctcggattgctgcgtaatgtggtcagcctggtgtcgttctcgatcatcctgtggggcgtgtcgggcagcatcgaagtgttcggcatcaccatcccggggtacatgttctggtgtgcgctgctatacgccgcggtgggcagttggttgacgcacctgatcggccgtcgcttgatcggcctgagcaaccagcagcagcgcttcgaagcggacttgcgtttctccatggtgcgggtacgtgagaatgccgagagcattgccctgtacaacggcgaaccgaatgaaagacaacgcctgagcacacgtttcggcaaggtctggcacaacttctgggacatcatgaaggtgtccaagcgcctgacctttttcactgccggctatagccagatcgcaatcatctttccgtttatcgtggcggcaccacgctacttcgctggcaagatcgagttgggcgagctgatgcaaatcaactcggcgttcggcaacgtgcaagagaatttcagctggtttatcaacgcttattcggaactggccacatggcgtgccaccagtgaccgtctgctgagcttccagcaggccatgaacgacaacgagcaacgcgtcccggccatcgatgtacgccctgaaggcgagcgcctggtgataaaggatcttggaatggacttggctgacgggcgtcatttgctcagcgacgccgacatgatggtggagcctggccagcgcgttatgctcagtgggcgttccggcagcggcaagagcaccttgctgcgagcgatggggcatctgtggccggccggtcatggcagcattcgcctgccagcgacacgctacctgtttctgccgcagaagccttacctgccgatcggtacgctcaaggccgtgttgagttatccacaggacgacggagtctattcgccagaacgttatgcacaggtcctggaaacctgtcgtctgccccatctggtcgcacggctggatgaagccaaccactggcaacgcatgctctcaccgggtgagcagcagcgcctggcctttgcccgtgcattgttgtacgcgccacaatggctgtacatggatgaagcaacctcggcgatggatgaagaggatgaggcgaccttgtaccaggcgctgatcgatgagttgccggggttgagcattgtcagcattggtcatcgcagcagcctcaagcgcttccatgggcggcatgtgcggattgagggtgggcggttgcaggagcaacaacttacttaagcttatgctcggtaagtgtgggagggggcttgctcccgatggcgacctgtcagtaacagatgcattggctgatccaccgctatcgggggcaagccccctcccacattgaatctcgattgttctctggacagtgtccacaaaaaagcccggctgattgatgatcagccgggcttttttattgcttgaggaagacttacttcttcaaaccgtaatgctcatccagcatgcctggggcgttcggcgtctttggcgcgtagtcccgtggtggctcctggttttcccgcggcggtgtcaggcgttcccgtggggtttgcggtgcatcggaatgcagcgcggccagcaggcgctggcgggtaatgtcgtcgagggccaggcgattagcgccatcggcgaggtgatcttgtacttcctggtagctctgggtgagcttcttgaccagggtcgcggtgctgttgaagtgggtaacaacctcgttctgataactgtcaaaacgttcctggatgtcatccagctgacgctgcgtgcggttaggcgcggcattcggcagcaagcgagcaaccaggaatccaatggcgacaccggcaaccagggcaagagtcggcaacaaccaaactaagagcgagtgttccacgagtccttcctctataaacggctttgctttacgttaacggctcggacctgcgctgtataccgcgattaagctcgcaatgatgccatgcacagacttttagctagacgagtcgaccccttgagaggtcacggagttcatccttgctcatgcgtgaaacccccgttttgatcgacggcccggtgggccaattggaagccttgtatctggatcaccccgaaccacgtggcctggcgctggtttgccaccctaacccggtgcagggtgggaccatgctcaataaagtcgtatcgaccctgcaacgcactgcccgcgatgccggtttgattactttgcgtttcaattaccgtggcgtcggtgccagtgccggcacccacgatatggccgccggtgaagtggacgatgctgaagcggccgccacctggctgcgggaaaaacacccggacctgccgatcaccttgctgggtttttccttcggcggctacgtcgcggccagtctcggcgggcgtttggaagccaagggcgagaagctcgcgcacctgttcatggtcgctgcggcggtgatgcgcctgggcgagtcggacgtgctgccccaaggctgcccgttgaccctgatccagccggaaagcgatgaagtggtcgacccgcaagtggtctacgcctggtccgccgccctgaaacgcccccgtgagttgctgaaagtggcagaatgcggacacttttttcacggcaagctgaccgatctcaaggatctggtgctgccacgcctttcgaattgatgacaagcgatcacccatgacgacccgtacccgtatcctcaccggcatcaccaccaccggcacgccgcacctgggcaactacgccggtgcgattcgtccggcgatcctcgccagcgaagatgccaatgccgattccttctacttcctggccgactaccacgccctgatcaaatgcgatgacccacagcgcatccagcgctcgcgtatggaaatcgccgcgacctggctggccggtggcctggatgtgaaccgggtgaccttctaccgccagtccgacatcccggaaatccccgagctgacctggctgctgacctgcgttgccgccaagggcctgctcaaccgcgcccatgcctacaaggcctcggtggacaagaacgtggaaaacggcgaggacccggatgcgggcatcagcatgggcctgtacagctacccggtgctgatggcggcggacatcctaatgttcaacgcacacaaagtgccggtcggccgcgaccagatccagcacgtggaaatggcccgcgacatcggccagcgtttcaaccacttgttcggcaacggtaaagaattcttcaccatgcccgaggcgctgatcgaagaaagcgtcgccaccttgccgggcctggatggccgcaagatgtccaagagctacgacaacaccatcccgttgttcaccagcgccaaggacatgaaagacgcgatctcgcggatcgtcaccgactcgcgtgcaccgggcgaagccaaggacccggacaattcgcacctgttcaccctgtaccaggcgtttgcgaccaaggcgcaggaagaagaatttcgtggcgagttgctccaaggcctgggctggggcgaggcgaagaatcgtctgttccaactgctcgacggccaactcggtgaagcgcgagagcgttaccaccaactgatgtcgcgcccctccgatatggaagacctgctgctgatcggcgccaagaaagcccgtgccgtggccgcgccattcctcgccgagttgcgtgaggcggtgggcctgcgttcgttcgtcaaccaggctgcggcgccggtcgcaaccaagaaaaaagcggcgaaggctgcgcgttttgtgagttttcgtgaagacgatggcagcttccgcttccgcctgctggccgctgatggtgagcaactgttgctgtcgcgcaactttgccgatggcaaagcagctggcgctgtgaccaaacaattgcaaagtggtgatgcgctggacgtgcgtgcgcaggctctgggcttcagcgtatggctggacggcgccgccgtggctgacagtgccgagttcgccgatcaagcatcgcgtgacgcggccatcgaagccttgcgctctgcgttgaccccaaccgaggattaacccgaccaagggttgattgccattatccagggccgtcgttacagtgacggcccgtttttgttgccttgctaacgaaattatgacgcccctagaacgatatcaagctgatctgaaacgccctgaattcttccatgacgcggcccaggaaaatgccgtgcgtcatttgcagcgcctgtacgacgacctcgtcgcggcctcgcaaagcaagccggggatgttcagcaagctgtttggcaagaaagaccacacgccggtcaagggcctgtacttctggggtggcgtcggccggggcaagacttacctggtggacaccttcttcgaagcactgccattcaaggaaaaggtccggacccacttccaccgcttcatgaagcgcgtgcatgaagagatgaagaccctgccgggcgagaaaaacccgctgaccatcatcgccaagcgcttctcccaggaagcgcgggtgatctgcttcgatgaattcttcgtctccgacatcaccgacgccatgatccttggcaccctgatggaagagctgttcaagaacggcgtgaccctggtcgccacctcgaacatcgtgcccgacggtttgtataaggatggcttgcagcgtgcacgcttcctgccggccatcgcgctgatcaagcagaacaccgatatcgtcaatgtcgacagcggcgtcgactatcgtctgcgtcacctggagcaagccgagctattccacttcccgctgaacgaagcggcccacgaaagcctgaaaaagagctttcgcgccctgacccctgaatgcacccaggcggtggaaaacgacaagctgatgatcgagaaccgcgaaatcatcgcgctgcgtacctgcgatgacgtggcctggttcgagttccgccagctgtgcgacggcccgcgtagccagaacgactacatcgagctgggcaagatcttccacgcggtgatcttgagcggcgtcgagcagatgggcgtcaccacggacgacatcgcccgccggtttatcaacatggtcgacgagttctacgaccgtaacgtcaagctgatcatctcagcggaagtcgagctcaaggacctgtataccggcgggcgcttgaacttcgagttccaacgcacgttgagccgtttgctggagatgcagtcccatgagttcctgtcgcgcgggcacaagccgtaagctgatgtgatccctataaaggcccgcagcgattgcggacctttatatttcgggtgctggttaaaaagtgatgtggtcttcagcgtccggcgccgcttctatgagggacttttggccgccctccatcttgtaggtcgcgccgtccgtccctttaaaaatcaccggcgacttatcctccgtttcatcttcctcctgtttccgctttctgtttacctcttcagcctgattttcctttgattcacatgcgcctgtctcgctcgcctgcatagccgggctgaaagagctgctgcctatggataacatgattgagtttccgtcctagtttgagccaaatggatttagaaaaagccctttaggatctgcaacgcagtccggcagaaatagacgactttttcctcgcttaaaatgccagacgcccagcgcgcagtaggttcgcctttgtcctgtctagctgtaggagttggaggtctcgcaggcaagcattgcttaaggcggcagagggttttcagtttgaccctgcaccattgcggtatggcagggtcgctttgcctcgtcaggggccgtatctacgcggcctgttggaattgttgccggtattggttcggcgacaactccgtgtgctgcctgaacaagcgcgcaaagaaactcgcatcgtcgtaacccacctcataactgatggtcttgatgctcttgcggctgcccgagagcaggccttttgccgtctcgatacgcagccgttgcaggtaatgcaacggcttgtctccggtagcggtctggaagcgccgcatgaagttgcgaatgctcatgccgtgttcccgagcgacgtcttcgaagcggaacttgtcggcaaagtgttcttcgagccagtgctggatctgcaggatgatcacgtcctggtgcagcttctgccccccaaagccgatacgtcccggtgaatagctgcgctgcacctcatagaggatgtcgcgggccacggcctgggcaatgctggcgccgcagaagcgttcgatcagatagatgtagaggtcgcaggccgaagtggtgccgccggcgcaatacaggttgtcggcatcggtgaggtgcttgtcctggttgagctgcaccttggggaagcgctcgctgaaggcagtgaagaaccgccagtaggtggtcgcctccttgccatcgagcagcccggcttctgccagccagaacaccccggtggcttcgccgcagagcacggcgccgcgggcatgttgttcgcgcagccacggcaatacttgcgggtagcgggcgcacaggccgtcgaagtcgtcccagaaggccggcagcacgatgatgtcggcatcttccaggccgccgtccactggcatgatcacatcactgaagctgcgcactgattgcccgtcggggctgaccaggcgcgtatcgaaccctggggtcaggcccaggccctgctgtttgccgtaacgcaggctggcgagatggaagaaatccttggcttgcatcagggttgaagcgaatacccgatcaatggccaaaatgctgacgcgccgcaagggcgtggagatttggttagacataatttcatttattcttataggggaaagtggtcaccagacggctggatcgtcttattttttgtcgcatgtgtccagtgtcccgtgacgccatcgcggcataggctctgtgggctcatccttgtccgacaatccatgcaggtgacccatgatccccagaaccttgttcagccaggagcacgaactctttcgcgagagcgtgcgcaccttcctcgacaaacacgccgcgcctttccacgggcaatgggaaaagcagggctacatcgaccgtagcctgtggagcaaagccggggaggcgggcatgctgtgctcccacctgccggaggaatatggtggcctgggtgcggactttctctacagcgcggtggtgatcgaagagatcagccgtcttggtttgaccggcatcggcttttccctgcattcggatatcgttgcgccctacatcctccactacggcaatgaagcgctgaagcacaagtacctgcccaaactgatttccggggagatggtcacggccattgccatgaccgagccgggcgccggttccgacctgcaaggggtcaagaccacggcggtgctggacggtgatgagtatgtgatcaatggctccaagacctttatcaccaacggctacctggccgacctggtggtcgtggtagccaagaccgaccccaaggccggcgccaagggcaccagcctattcctggtggaagccggcacgcccggcttcgacaagggcaagcgcttggagaaagtcggcatgaaggcccaggacacctcggagctgttttttcaggacgtgcgggtgcccaaggaaaacctgctgggccaggccggcatgggctttgcgtacctgatgcaggagctgcctcaggagcgtttgaccgtggcgataggtgcactgtcttcagccgaagcggcattgcagtggaccctggactacacccgcgagcgcaaagcgttcggcaaggcgattgccgacttccagaacacccgcttcaaactggcggagatggccaccgagattcagatcggccgcgtgtttgtcgacaagtgcatggcgctgcacctggaaggcaagctggatgtgcctaccgcggcgatggccaagtattgggccacggacctgcaatgcaaggtgctcgatgagtgcgtgcagctgcacggcggctacggcttcatgtgggaatacccgattgcccgggcctgggcggacgcgcgggtgcagcgcatttatgcgggaaccaatgagatcatgaaggagattattgcgcgggcgctttgatcttgcggtgttgctgatggcctcatcgggagcaagtcgaatcgtcgcaccgcccttcccacatttgactgggtttataagtccaaatgtgggagggggcttgctcccgatagcggcctaaaggtcaatcaaggcgccggattcggatgatccttctgaatcgcctcaatcccctccaatacttctttcgacagtctcagatcagcactggcaatattgctatccaactgctccagcgtcgtggccccaataatattgctggtcacaaacggctgctgcgtcacaaacgccagtgccatctgcgccgggtccaggccatgttcgcgcgccaatgccacatagcggctgcacgccgcctccgactgcgggttgaagtaacggctgaaccggctgtactcagtcaggcgtgccttggccggccgtgcgccattttcgtatttgccgctgagcatgccgaacgccagtggggaatacgccagcaagccgcactgttcgcgaatggcgatttccgccaggcccacctcgaagctgcggttgagcaggttataggggttctggatcgacaccgcccggggccagccgcgagcttcggccagggcgaggaacttcatggtgccccacggggtttcgttggacaggccgatgtggcggatcttgccggccttgacctgctcatccagggcttcgagggtttcctccagaggagtgaggtcgtcttcgtccttgtgcttgtagctcaactggccaaagaagttggtgctgcgctccggccaatgcagttggtagaggtcgatccagtcggtctgcaggcgcttgaggctggcgtccagggcctgggcaatgtgcttgcggttgtggcgcaggtagccatcgcgaatgtagtcgatggtgttgccgggacctgcgatcttgctggcgagaacccagtcggcgcggtcgccacggcttttgaagtaattgccgatgtagcgctcggtggtggcgtaggtatcggccttgggcggtaccgggtacatttccgcggtatcgaggaagttgatccctgcggccttggcccgttcgatctgcgcgaaggcctctgcctcactgttctgctcgccccaggtcatggtgcccaaggcaatcgcgctgacgttcagatcggtgcggcccagctgtcggtaatccatcgggtactccttcggggaaaacaatcataaaagcaggttgaattttttttcgcaatctgcataattgcccacctctttctgcagtggaagtgatgcgccgtctgccgaagaatcttgccgttgaacggacgcgccgacccgagcccccgatagcgtctgtatccggctgcctttgacttgtcaaagtaagcactattcagtaagatccgccgtctaatttacagggcggcccctgaggctattaaagaatgacaacttttactgcaaaaccggaaacagttcagcgcgactggtttgtcgtcgacgccgctggtcagaccctgggtcgtctggccactgaagtcgccagccgtctgcgtggcaagcacaagcctgagtacacccctcacgttgacaccggtgactacatcgtgatcatcaacgctgagcaggtacgtgttaccggcaacaaagcgcaagacaaaatgtactaccgtcactccggtttcccaggcggtatcaagtcttccaactttgaaggcctgatctccaagaagcctgaagccccgatcgaaatcgcggtcaaaggcatgctgccgaagggcccactgggtcgcgatatgtttcgcaagctgaaagtctatgcgggcgctgtacaccctcatgctgctcagcagccccaagaactgaagttttaacggaatagttcattatgtcggcgactcaaaattacggcactggccgtcgcaaaaccgcaaccgcacgcgttttcctgcgtccgggcactggtaacatctcgatcaacaaccgctccctggacaacttcttcggtcgcgaaactgcccgcatggtagttcgtcagccgctggaattgaccgagaccgttgaaaagttcgacatctacgtcaccgttatcggtggcggtgtaagtggtcaagctggcgcaatccgccacggtatcactcgcgctctgatgcagtacgacgaaaccctgcgtggcgctctgcgcaaagctggcttcgtgactcgcgatgctcgtgaagttgaacgtaagaaagtcggtctgcgtaaagcgcgtaagcgtccgcagtactcgaagcgttaattcgctttacgttccacaaaaacgcccagcctcctcacggagctgggcgttttttattgcctgcgatttatacataaatttgtgcgtgacaacttgccacatccgtagaccccctatactacaaggcctgggggcggaggcccgggcaattcccttgtcatacgtggggcttttcattaccatccgtcaaaatttttataagtaaagtttcaacacttagtagacgcctgatttaacaggccaaaaaagctgatgggagaggactgaatgagcaatgacggcgtgaatgcaggccggcgtcgcttcttggtagcagccacatccgtggtgggtgctgcaggagcggtgggggctgcggtcccgttcgtggggtcatggtttcccagtgccaaggcgaaagccgcaggtgcaccggtgaaggtgaatgtcagcaagatcgagccaggccagcagatgattgctgagtggcgcggccaaccggtattcatcgttcgtcgtaccgaggaaatcctggggaatctgaagaagatcgagggccagttgtccgacccgcaatccgagaattccgaccagcccgcctacgccaagaacgaagtgcgttcgatcaagccagagattctgctgctggtcggtctgtgtacccacctgggttgctcgcctaccttccgcccggaagtggcccctgtcgatctgggcaaggactgggtcggcggttatttctgcccgtgccacggttcccactacgacctcgccggccgagtctacaagtcccagcccgcgcccttgaacctgcccgtgcctccgcatacctacgaaactgacgacctcatagtcattggcctcgacaaggagaacgcgtgatgagcaagttcatggattgggtggatgcgcgcttccccgccactaaaatgtgggaagaccatctcagcaagtattacgcgccaaagaacttcaacttcttctacttcttcggctccctggccctgttggtgctggtcaaccagatcgtcaccggcgtgtggctgacgatgagctacaccccgtcggcggaggaggcgttcgcttccgttgaatacatcatgcgtgacgtcgagtacggctcgatcctgcgcctgctgcactccaccggcgcgtcagcgttctttatcgtcgtctacctgcacatgttccgtggcctgctctacgggtcgtaccagaagcctcgcgagctggtgtgggtgttcggcatgctgatctacctggcgctgatggccgaagccttcatgggttacctgctgccgtggggccagatgtcgtactggggcgcccaggtgatcatttcgctgttcggtgcgatcccggtgatcggcaacgacctgacccagtggatccgcggtgactacctgatctcgggcattaccctgaaccgcttcttcgccctgcacgtggtggccttgccgatcgtgatcctcggcctggttgtgctgcacatcctggcgctgcacgaagtgggctccaacaaccccgatggcgtggacatcaagaagcataaggacgagaacggcattccgctggatggtattccattccacccgtactacaccgtcaaagacattgtcggcgtggtggtgttcctgttcgtgttctgctcgatcgtgttctttttcccggagatgggcggttatttcctcgagaagcctaacttcgagcaggccaacgccttcaagactcccgagcacattgcgccggtgtggtacttcacgccgttctacgcgatcctgcgcgccatccctgacaagctgatgggcgtgatcgccatgggcgcagccatcgcggtgctgttcgtgctgccatggctggaccgcagtccggtcaagtcgatgcgctacaaaggctggctgagcaagatctggttgtgggtgttctgcatttcgttcgtgatcctgggcgtactcggcgtattggcgccaacccctgagcgtacgttgctgtcgcaggtctgcaccttcctgtacttcgcctacttcattctgatgccgttctatacccggctcgagaagaccaaaccggttccggaaagggtgactggctgatgaaaaagttattcgttgcattcgtgcttgcggccttgccgctactgtccttcgccgctgaacatggcgcgcagctggaaaaagtcgatatcgatgtgtctgacaaagccgccatgcaggatgggctgcgtacattcaccaactactgcatgggttgccacagcgccaagttccaacgttacgagcgtgtcgccgatgacttgggcatcccccatgaagtgatgctcagccacgcggtgttcactggcgcgaagatcggcgaccacatgaacaccggcatgcaaccggccgatgccaaggcctggttcggcgccgcaccgcccgacctgaccctggtggcccgcgtgcgcggcaccgactggctctacggctacctgaaatccttctacgaagaccctgcgcgcccgtatggcgtgaacaacaaagtcttcccgaacgtcggcatgccgaacgttctggtcggcctgcagggtcgtcaagtggtaggatgcaagcaggttcaggtcgttgaagacggcaagaagcaatatgatccgttgaccggtacgcctctgacccatgaagcgtgcgatcaactgaccatcgtgcccaagaccggtacgctgaatgaagagcagttcgacgagaaggtcaagaacctggtgaccttcctggcttactcggccaacccggtcaaactgcagcaccagcgcatcggtacgtacgtcttgctgtacctggctttcttcttcgtattcgcttatctgctcaagcgcgaatactggaaggatgtgcattgatccaaccgtaagcaattgctgttaatcttgcgcgcccagcggcatctctgaacacgtagcgaccggttgaaccggacgttacagggatgctctctgggcgcgctcgtttttgagctttcgataatttcaacaagcgaggaggaccgccatgggcgtgaccagtcggttggcctgttactccgaccccgccgaccactattcccaccgagtacgcatcgtgctcgcagagaagggtgtcagcgccgagatcatcagtgtggaagcgggccgtcatccgccgaaactgatcgaagtgaacccttacggcagcttgcccaccctggtcgatcgtgacctggcgttgtgggagtcaaccgtggtgatggaatacttggatgagcgttaccctcatccgcctttgctgccggtatacccggtggcgcgtgccaatagccgcctgctgatccatcggatccagcgcgactggtgcgggctggtggatgtgattctggattcgcgttcaaaagaagccgctcgggtgcaggcgcgcaaggaattgcgcgagagcctgaccggcgtttcgccgttgttcgccgataaaccttttttcctcagtgaggaacaaagcttggtggattgctgcctattacccatactctggcgtttgccgatcctgggcattgaactgccacggccggccaagccgttgcttgattacatggagcgccagtttgcgcgtgaggctttccaggcgagtctgtctggtgtcgaacgcgatatgcgctaaggcttaaggagccgttgatgaactccagtcgaccttacctggtccgcgcgctctatgagtggattgtggacaacgattgcaccccgcacatgctggtcaattccgaatttcctgcggttcaggtaccgcagggttttgccagcgacggacaaatcgtgctgaacgtatcgcccagtgccgtgcgccacctgcacatggacaacgaagcggtgagcttcgaaggacgtttcggcggtgtaccccatacgctgttcgtgccaatcggtgccatcctcgggatttatgcccgggaaaatggccaaggcatggtgttcgatctggagtcgcctttcgaggatggcgaaacgatcgaaggtgaaggcagtgatgatgtgccgccaccggataccgagccgccgcgccctagtggtcggccgagcttgaaagtggtgaagtaggcggattacgcctccaggcccatgtgaaaaatgcctcgactgctgtcggggcattttttttgcgcgaaggatatggatgaaagtcgcgccggaacggtgatcgtacaaccaccatgggctatgatgcggtctttagttcgccgagaaagatggttcatcatggaaaacgccagcgccgctccacgtcttccccgcaagcgccgcagccttgcccaggaattggtcacggtgttgtccgagcagatccgcgacggccagctcaagcgcggcgacaagctgcccaccgagtcggcaatcatggacgcccatggcgtcagccgcactgtggtgcgcgaagccatctcgcgtctgcaagcggcggggcaggtcgagacccgccacggtatcggcacctttgtgctggacacgccaagccccagcggtttccgcattgacccggccaccgtggtgacgttgcgtgatgtgctggcgatcctggagctgcgtatcagccttgaagtagagtccgcgggccttgcagccttgcgtcgcagcgatgcacagctggcggcaatgcgtgcggccctcgatgccctgaacgaaagtgcggcccatgccggcgatgcggtagcttcggactttgccttccacctggaaattgcgttgtctaccggcaaccgttacttcaccgacatcatgacccacctgggcaccagcatcattccacgcacacgcctgaattcggcgcgcctggcccatgatgaccaacagcactacatgagccgcctgagtcgcgaacacgaagagatttatgaggcgattgcgcgccaggattcggatgcggcacgtgcggctatgcgtctgcatttgaccaatagccgtgagcggctgcgccatgcccatgaagaggccgaggcgcagcgcggttgaaggctgattcgccgcgatacaaatgtgggaggggcggtgcgacgattcgacttgcccgcgaagacgtcggcccagcaaacattgatgtcggttgacccaccgctatcgggggcaagccccctcccacagttgatctccattgcctggagtattgcggctacttagctggccggttgattgggcttgtagtccttaagcaacaaatacgtactccaccccccccaatcattggtccagtgcttgtcgttcaggtcattgacgtccttgcgccgcagcaccttgtctccctccatcttgaacagtggcgagaagttattcgccgggttttgcgccgcgttcaagtcgggcacatacaacggtgccttgaagctggccggggagggcgcgataccgctgatgaaggtctcgaagatctcatcagccgaagcctgtactgcgcgtttgacctgcatgcggttgtccgcgtcgatgtcatcgaagtagcgtttatccccataggcgtgccattgatcgcccatggcattgcgcaccttgagcccgaacttgctgtcttcatcgtgcatgaaacggctgatcagcgaacccagttcacccggcgtcactaccgctgccagttgcttgcgcggtacgcgcaggtggccggcggaaaacaggtcagtcaagaaatgatcagcaaagctgttcatcgcataagccagctcaagggcctgatcggtgccggtttgatgggccgcgacggcctgttgcagtgccgctgtgtggccggccaggtacgccgacagggcccactcgccgaagtggtcggcgttgtccgccgccagcttcaggtagcgccccagggggatgagggctgaaacagcactgccaccgccggtgatgcggttccactcctcggacaacgtatcacccaaggcgtcataggcttcgtggggctgcttgccgtccttgatcgcctgcttgactgcggcgatctccttttgcatcaccgccaggatcttgtgggcctcttcccgggaggccggcagcactgccagagagttaaaggcggcagtgaaacgttgcgcacgctcggctggggaggcgccatcgctgatggcctggccaggaatgccatagaaatcgccgcccagggcaatgacttggccgtaggtcagcgcgagtccgttgggcaggtgcagctcgacttggtgggcgggaattgctggcgcgtccttggcgaaacgcaaaagggtttcatcaccgatggcggtgtgctcacccccttcgaaacgtagggtaggcgcttgcttttgcggtgcagcgagttctagacctgacatgttagctccttgctatgtcgtaggaatcttccttgatcactgtatgtaaatacagtaattatgagcataaaggagaaatttcctacgtcaagaagcttcgttaagcgtgtcggctttgcgatgaacagcgatgaattggagttgacgaatctttttatagttgtacgatgacgtacgacatcaccaaaaccaacaacaacctttcgttagaaagtcttcgcccagggtgttcgaataatgaatccacaagaactgaagtccatcctctcccacggtctgctgtcttttccggtgactgatttcactgcccagggtgatttccaccaggcgggctatatcaagcgcctggaatggttggccccgtatggcgccaccgccttgttcgcagcgggtggcaccggtgagtttttctccctcgccgccagcgaatattcccaagtggtaaaaaccgccgttgatacctgcgccaccagcgtgccgatcctggccggtgtgggcggcgcgacccgtcaggccatcgagtacgcccaagaggccgaacgcctcggcgccaaaggcttgctgctgctgccgcactacctcaccgaagccagccaggacggggtggctgcccacgttgaagcggtgtgcaagtcggtcaagatcggcgtagtggtctacaaccgcaatgtctgccgcctgactgcgccactgctggagcgcctggccgagcgctgcccgaacctgatcggctacaaggatggcctgggtgacatcgagttgatggtgtcgatccgccgccgcctcggcgaccgtttcagctacctgggcggcttgccgactgccgaggtttacgctgcggcctataaggccctgggggtgccggtgtactcctcggcagtgttcaacttcatcccgaaaactgcgatggacttctatcacgccattgcccgcgaagatcacgccaccgtcggcaagatcatcgatgacttcttcctgccgtacctggacatccgcaaccgtaaagccggttacgcggtgagcatcgtcaaggccggtgcgaaaatcgtcggttatgacgccggcccggtgcgcacgccgctcaccgacctgctgccggaagagtacgaagccctcgccgcgctgatcgacaagcaaggcccgcagtaaattatccacaaggccgctgagcaatcagcggccttttgcgtcaggagaagattcgtgtcccaagcacagcgttttgagaactacatcaacggcgaatgggtaagcggtgccgattactgcgccaatatcaacccgtcggatgtgtccgatgtcattggcgactatgccaaggcggatgtggcccaagtcaacgcggctatcgacgccgcccgcgcggcgttcccggcctggtccacttccggtatccaggcgcgtcacgatgccctggacaaagtcggcagcgaaatcctcgcccgtcgtgaagagctcggcaccctgctggcccgtgaagagggcaagaccctgccggaagccatcggcgaagtgacccgcgccggtaatatcttcaaattcttcgccggcgaatgcctgcgcctgtcgggtgattacgtgccgtcggtgcgcccgggcgtcaacgttgaagtcactcgcgaagcccttggtgtggtcggcctgatcaccccgtggaatttcccgattgccatccctgcgtggaagatcgccccggccctggcctacggcaactgcgtggtgatcaagcccgccgaactcgtgccgggttgtgcctgggccttggcggaaatcatctcccgtgccggtttcccggccggtgtgttcaacctggtgatgggcagcggccgtgtggtcggtgatgtgttggtcaacagcccgaaagtcgatggcatcagtttcaccggctccgtcggcgtgggccgtcagatcgccgtcagctgtgtatcgcgccaggccaaggtgcagttggaaatgggcggcaagaacccgcagattattctcgatgacgccgacctcaagcaggccgtcgagttgtcggtacagagcgcgttttactccaccggccagcgttgcaccgcgtcgagccgcttgattgtcactgcgggtattcacgatcagtttgtggcggccatggccgagcgcatgcagtcgatcaaggtcggccacgcgctgcaaagcggcaccgacatcggcccggtggtttcccaggcccagttggaccaggacctgaaatacatcgacatcggccaaagcgaaggtgcgcggctggtcagtggcggtggcctggtgacctgcgacaccgaaggctattacctggcgccgacactgtttgccgacagcgaagccgccatgcgtatcagccgtgaggagatcttcggcccggtggccaacgtggtacgcgtggcggactacgaagcggcgctggccatggccaacgacaccgagttcggcttgtcggcggggatcgctaccacctcgctgaaatacgccaaccacttcaagcgccactcccaggccgggatggtgatggtcaacctgccgactgcgggcgtggattatcacgttccgttcggcggccgtaagggctcatcctacggttcgcgtgagcaaggtcgctatgcgcaagagttctacaccgtggtgaaaaccagctacatcggttcgtaatacccgtttcactgtaggagcgagcttgctcgcgaagaacgtcaacgattacgcgcgcattcaggatgtacgcggcgtctgcgagtttttcgcgagcaagctcgctcctacagatggcggtacccagcaatacataactattacccgcaaaaaaaataattagtgggagtacttctacatgcaagcgaccaagccgacccatgtccgctatttgatcctgctcatgctgttcctggtgaccacgatcaactacgccgaccgggccaccatcgctatcgccggttccagcctgcaaaaagacctcggcatcgacgcggtcaccctcggttatatcttttccgctttcggatgggcctacgttgccgggcaaatccccggcggctggctgctcgaccgcttcggttcgaaaaaagtctatgccctgagcatcttcacctggtccttgtttaccgtgctgcaaggctatgtcggtgagttcggtatctccaccgctgtggtggcgctgttcatgctgcgctttatggtgggcctggccgaagcgccatccttcccaggtaacgcacggattgtggcggcctggttccccacggctgaacgcggcactgcatcggcgatcttcaattcggcgcagtacttcgccacggtgttgttcgcgccattgatgggctggatcgtctaccgctttggctggcagcatgtgtttatcgtgatgggcgtgattggcatcgtgttctcgctgatctggctgaaagttatccacagccctcgccagcacccgatgatcaacgaggccgagttcaatcacatcgcggccaatggtgcgatggtcgacatggaccaggacaaaggcaagggcaagaaaaccgacgggccgaagtgggattacatccgtcaactgctgaccaatcgcatgatgctcggcgtgtacctgggccagtactgcatcaacggcatcacctacttcttccttacctggttcccggtgtacctagtgcaggaccgtggcatgaccattctcaaggccggtttcattgcctcgttgccggcgatctgcggctttatcggcggggtgcttggcggggtgatttccgattacctgctgcgcaagggccactccctgacctttgcccgcaaggcgccgatcattggcggcctgctgatttccagcagcatcgtggcgtgcaactacgtggatatcgaatggatggtggtgggcttcatggcgctggccttcttcggtaaaggcgttggcgcactgggttgggcggtggtgtccgacacctcgccgaaacagatcgccggcctcagtggcggcttgttcaacaccttcggtaacctggcctccattaccacgccgatcgtgatcggctacatcatcagcaccactggctcgttcaaatgggcgctggtgttcgtcggcgccaacgccctggtggcggtgttcagctatctggtgattgtcggcccgatcaagcgcgtggtgctcaaggagccgcccaccaaaggcccggagttgaccaacctttcccaagcgcattcctgaggttcgtgtgatgcagttgattgaacatgccgactcgccgcgctcgatccgtttgcacgagcgcgacaacgtagtgatcgtggtaaacgaccagggcgtgccagcgggcactgaatttcccgatggcctggtcaccgtggattttattccccagagccacaaggtgaccctggaagatatccccgagggcggtcggatcattcgctacggccagaccatcggttatgccttggcgccaatcccccgtggcagttgggtgcaggaagatcaactgcgcatgcccaccgcgccgcccctggacagcttgccgctgtccaccgaggtgcctgaaacccaggcaccgctggaggggtttaccttcgagggctatcgcaatgccgatggcacggtgggtacgcgcaatatcctcggcattaccactaccgtgcagtgcgttaccggtgtgctggaccatgcggtcaagcgcatcaaggacgagctgctgcccaagtatccccatgtcgatgacgtggtggcactgacccacagctacggctgcggggtggcgatcacggcgacggatgcctatatcccgatccgtaccgtgcgcaacctggcacgtaacccgaacctgggcggcgaagccttggtgatcagcctgggctgcgagaaattgcaggccgggcaggtgatgcacgacaacgacagctccgtggacctgagcgagccatggctgtaccgcttgcaggactccagccacggttttaccgaaatgatcgaacagatcatggaactggccgaagtgcgtttgaaaaaactcgaccagcggcgccgggaaaccgtgccggcctccgagctgatcctgggcatgcagtgcggcggcagtgatgcgttttccggcatcaccgccaacccggcgctggggtatgcctctgacctgctgctgcgggctggggcgacggtaatgttttccgaagtgacggaggtgcgtgatgcgatctacctgctgacgtcgcgcgcgcaaaacgaggacgtcgcccgcgaactagtcagggaaatggactggtacgatcgttacctggctaagggcgaagccgatcgcagtgccaataccacaccggggaacaagaagggtgggctatcgaatatcgtcgagaagtccctgggctccatcgtcaagtccggcagcagcgcgatcaatggcgtgctcggcccgggtgagcgtttcaagggcaaagggctgatcttctgcgctacaccggccagtgatttcgtgtgcggcaccttgcaactggcggccgggatgaacctgcatgtgttcacaaccgggcgcggcacgccctatgggttggcgatggcgccggtggtaaaggtctcgacccgtaccgagctggcccagcgttggccggacctgatcgatatcgatgccgggcgcattgctaccgggcgcgcgagcatcgaggagttgggctgggagttgttccacttctatttggatgtggccagtggcaggaaacagacgtgggcggagcatcataagctgcacaacgacatcaccctgttcaacccggcgcctattacctgagaccgaggcgcctgcatcgggggcaagccccctcccacattcgatcgggtgaacgcggtcgaggtgggagggggcttgcccccgattgcggtagaccagacgacacgggctgcatggcttatcattagccaactaacgacacccaccaaggttctccccggcatgctggcaattttcctcaccaccctcaccatcaccgcgccggtgttcgccatgctgttcctcggtgtgctgctcaagcgcatccaatggatcaacgacaactttatccataccgcttcgtcgctggtgttcaacgtcaccatgccggcactgctgttcctgggcatcctgcatgccgacctgcacgcggcgctcaagcccggattactcatctacttctcaatcgccacgctgctgagcttcgccctggcatggggctgggcgatctttcgttgcaagcgtgaagaccgtgggatctatacccaaggcgcgtttcgcggcaacaacggcgtgatcggcctggcgctggcggccagcatgtacggcgactacggcatctccctcggcgcgatcctcgcggcgctggtgattctgttctacaacacgctgtcgaccattgtgttggcggtgtacagcccggtgatcaagtccgacccatggagcatcttcaagagcgtggtggccaacccgctgatcatcagcgtgatcgtcgccgcgccgttcgcttacttccagatcggcctgcccggctggttggaaaaatccctgcagtacctatcggataccacgcttccgttggcgttgatctgcatcggcggcaccttgtccctggcggcactgcgcaaaagcggcaacatggcgctgagcgcaagcttgatgaagatggtctggctgccggtaatcgcgaccctgggcgcctggctattggggtttcgcgggccggagctgggcattctgttcctgtatttcggcgcgccgaccgccgccgcgagcttcgtgatggccagggcggcgcaaggtaatcacgagctggcggcggcgatcattgtgatcaccacgctgatggcggcggtgaccaccaatatcgggatcttcgtgttgcaggccggtggctggatctaggcgtctttctggtagctgtcgatcacttcctgcgcggcccgaaacgcgtcaatcgccgccggcacccctgcatacaccgcgcaatgcagcagcgcttcgcgtatctcttcgaccgtacagccattgttcaaggcaccgcgcacatggcccttgagttcctgcgggcacttgagggcggtcagggcggcgagggtgatcaggctgcgggtcttgagcggtaagccttcgcggttccatacgctgccccacgcatgctcgttgacgaaatcctgcagcggctgggtgaacgccgtggcattgcccaaggcgcggtcgacgaacacatcgcccatgacttggcgacgcacttcaacccctggccttttctgatcgttcattgcgattccctcttgtgttggcgatgccaggcgcgcagtgaggtaagcaacagcaaaatcaccaacgccggcaggacgtaatacagcatcagtttttcaagcttgttggccaggggcatgccggtggtgaaggccatcacatgcagaccgtacgccagatatagccccagcagcaccagcccttcgatacgcgttacccgataaccggtatagaacaccggcaagcacaggatgatggcgccgagcatgaccggcaaatcaaaatccagggcattgggggataccgacagcggcgacggcgccaccagcgcggtaaagcccagcaccccgagcaggttgaacaggttgctgccgatcacgttgcccaccgcaatttcccgttcgccccgcaaggcggcgatcagtgacgtggcgaggcagggcagtgaggtgcccacgccaatcagcgtcaggccgatgacccgctccgacaggcccaggtcgcccgccacgtccaccgctgcgccgagcagcagatgcccggccaataccaataccagcagcccgccgagcatcagcaacacactgctcagccagggggcctgggtgacggtgtccaggcttcgcgggcggcgcgaatggcgcgtctggtaatgcagcacgcccaggtaggccagcagcgccaccagcaatacgccgccatccaatggcgtgagcatttcgttggcagccaggataaacaccagcaggccggcgaagatcatcaccgggatatccacgcgcaccagctgccgcgatacgcgcaagggaatgatcagcgccgacaggcccagggtgacgaggatattgaagatactgctgccaatcacgctgcctacggcaatgtcggtattgccggccagggtggcctgcaggctgacggtcatctgcggtgcgctgctgccgaaggcgacgatgctcaagccgatgatcagcggtcgcaccttgaggctggccgccaggcgcacggcggcgcgcaccagcacttcagcgccggcgatcagcagcagcaggccgccaaccagttcgagcaggctccagggcgaaagggcgttcaacgcgaaaatgctcaaggctgcctcgtcagttgttcagggcttgcacgcgaacccgtgcggtaccgctgcccagcatacgcagttgctcggcagccttgcgggaaaggtcgatcaggcgcccgcgggtatgcgggccgcggtcattgatacgcactaccaccgatcggtcgttgtcgagattggtcaccttgacctgggtgccgaagggcaggcgcctgtgggcggcggtcagggcgttctggttgaaaggttcaccactggcggttcgcttgccatggtgcctggcgccgtaataggaggcggtgccggtttcgtcgtagcctttggggtcgatgaggccgctggcgcaaccggccagcagggaggacagggccaggaggccgagtagacgcttcattgtcaggaaatccccaataaaaaatgtggagagggggcttatgtgggagggggcttgctcccgatagcggtgaagcagtcaacacatgtgttgactgaaacgccctcatcgggagcaagccccctcccacacaggttggagccagaccttgaagtctgctccaaccatttcacggctatcagccttcgagcttgcttttcagcagttcgttgacctgttgcgggttggccttgcccttggaggctttcattgcctggccgacaaagaagccgaacattttgccgcgcttggcttcgtctgccgcgcggtattgctcgacctgttcggcattcgccgcgagcatttcatcgagcacggccgagatggcgccgctgtcggtgacttgcttgaggccgcgcttgtcgatgatctcgtcggcgctgccttcacctgcggccatggcttcgaacacggtcttggcgatcttgccggagatggtgttgtccttgatgcgcagcagcatgccgcccagttgttcggcagtgaccggcgcttcgtcgatttccaggccctgtttgttcaacaggctgcccagctcaaccatcacccagttggccgccagcttggcgtcgccggcaatgcctacgactttctcgaagtagttggcttgctcacggctggaagccagcacgctggcatcgtagatcgacaatccgaactgcgcctggaagcgctcgcgtttttgctgtggcagttccggcagggtggcgcggatgtcattgaggaatgaatcctccagcaccaccggcaacaggtctgggtcggggaagtaacggtagtcgttggcttcctctttgctgcgcatggcgcgggtttcgtctttgttcggatcgtacaggcgggtttgctggatcaccttgccgccgtcctcgatcagttcgatctggcgacgcacttcgctgttgatcgccttctcgatgaaacggaacgagttgacgttcttgatctcgcagcgggtgccgaactcgacctggccctttggccggatcgacacgttgcaatcgcagcgcagcgagccttcggccatgttgccgtcgcagatgcccaggtagcgcaccagcgcatggatggtcttgacgtaagccacggcttccttggcgctgcgcatgtccggctcggagacgatctccagcagcggtgtgccggcgcggttcaggtcgataccggtggcgcccgggaattcttcgtgcaggcttttgccggcgtcttcttccaggtgtgcacgggttacgccgacacgcttgatggtgccgtcttccagtgcgatgtccaggtggcccttgccgacaatcggcaactccatctggctgatctggtagcccttgggcaggtccgggtagaagtagttcttgcgcgcgaacacgttgtgctggccgatctcggcgtcaatcgccaagccgaacatcacggccatgcgcaccgcttcctggttcagcaccggcagaacgccgggcatgcccaggtcgaccaggctggcctgggtgttgggctcggacccgaacgtggtggcgctaccggagaaaatcttcgattgggtggcgagctgggtatgaatctccagcccgatcacaacttcccattgcatagtgttctcctcagaagccggtaggggtgcgggtgtgccagtcggtgtgcaactggtactggtgcgccacattgagcaggcggccttcctggaaatacggggcgagcaattgcacgccgaccggcaggccatcgacgaaaccggcgggcatggacaagcccggcaagcccgcgaggttggcggtgatggtgtagaggtcttccaggtactcggcgatcgggtcgccggtcttggcgccgatcttccaggccgggtttggcgtggttgggccgaggatcacgtcgacttcttcaaaggcggccatgaagtcgttcttgatcaggcgacggatcttttgcgccttgaggtagtacgcgtcgtagtagccagccgacagggcgtaggcaccgaccatgatccggcgctggacttcactgccgaagccttcgccacgggagcgtttgtacaggtcggtgaggtccttggggttttcgcagcggtagccgaagcgcacgccgtcgaagcgcgacaggttggaggaagcttctgccggcgcgatcacgtagtaagcgggaatcgcatgctggttgttcggcaggctgatttccttgatgacggcgccgagcttttccagctccttgatgctgttttgcaccaggtcggcgatacgcgggtcgaggccggcgctgaaatactcttttggcacgccaatgcgcaggcccttgatcgaggtgttcaggctcgcgctgtagtccggcaccggctcatcgatactggtggagtcctgtttatcgaagcctgccatgccttgtaacaatatcgcgcagtcttcggcagtgcgtgccaacgggccgccctgatccaggctggaagcgtaggcgatcatgccccagcgggaaacgcgaccgtaggtcggcttcaggccggtgaggttggtgaaggccgccggctggcggatcgagccaccggtgtcggtagcggtggcagccgggaggaagcgcgcggcaacggccgcggccgaaccaccggacgagccacccggcacgtgttccaggttccacgggtttttcaccgcgccgtagtagctcgactcgttggccgaacccatggcgaattcatccatgttggtcttgcccagggtcacggccccggcagcggccagcttggcgaccacggtggcgtcgtagggggccttgaaattgtcgagcatcttcgagccgcaactggtgcgaatgccctgggtgcagaacaggtccttgtgggcgatcggtgcgcccagcagcgcgccattttcaccgttggcgcgacgggcgtcggcggccttggcctggctcaatgccagctcctcggtgaggctgatgaagctgttgaccttgggatcgtgctcggcgatacgcgccagcagggtctgggtcagttcttcggaagaaaacgttttgtcggcgagaccgcgggcgatctcggccagagtcatgtgatgcatgaaaggctctttccctttagtcgatgactttcggaaccaggtacaggccgttttcgaccgctggcgcgatggactggtaggcctcgcgattattttgctcggtcacgacgtctgcgcgcaggcgctggctggcttccagtgggtgagccaggggctcgatgccgtcggtattcacggcctgcatttggtcgaccagcccgaggatgctattcagggctgcggtggtctgtggaagatcggcatcattcaggccaagcgaggccagatgtgcgattttttccacgtcggagcgttcaagcgccatgggattctccagtggaaaacagaacggagggcgtccgtgtgttagattgtcggaacactaccgcatttctacggtcataaggccgcgattgtgggggttggtgcacagaaagtcggccaatttagcacattggcgccttgcccaaaatccctgtcgttgttagagtttgccgcacttttttacccacgcgttgcctagggtccctttcccatgttcaagaaactgcgtggcatgttttccagcgatctttccattgacctgggcactgccaacacccttatttacgtgcgcgagcgcggtatcgtcctgaatgagccatcggttgtggccattcggacccatggtaatcagaaaagtgtcgttgccgttggcaccgaggccaagcgcatgctcggccgtacaccaggcaatattgctgccattcgtccgatgaaggatggcgtgatcgccgatttcagcgtctgcgagaagatgctgcagtacttcatcaacaaggttcacgaaaacagtttcctgcagcccagccctcgtgtgctgatctgcgtcccgtgcaagtccacccaggtggagcgtcgtgccatccgtgagtcggcccttggtgccggtgcccgcgaagtgttcctgatcgaagagccgatggcggccgcgatcggtgccggcctgccggttgaagaagcccgcggctcgatggtggtggatatcggtggtggtacgaccgaaatcgccctgatttccctgaatggtgtggtgtatgccgaatccgtacgcgtcggcggcgaccgcttcgacgaagcgatcatcacttatgtgcgtcgtaactacggcagcctgatcggcgaatcaaccgccgagcgcatcaagcaggaaatcggcaccgcttacccgggcggcgaagttcgcgaagtcgatgttcgcggtcgcaacctggccgaaggcgttccacgtgccttcaccctgaactccaacgaagtgcttgaggctctgcaggagtccctggccaccatcgttcaggccgtgaagagcgccctggagcaatcgccgccggagctggcttcggatatcgccgagcgtggcctggtgctgaccggtggtggcgccttgctgcgcgatctggacaagttgctggcccaggaaaccggcctgccggtgatcgtcgccgaagacccgctgacctgcgttgcccgcggcggtggtcgtgcactggaaatgatggataaacacaccatggacctgctttccagcgaataagacgcctggaaggttcatgcatggtcggcaggcagcactttgcagtgctgcctgttggcgtttatcttcttcaatctgcatccaggccggtttgatgccgtatgaataaagagaacatttgcctgggaggagcggcctattaaaccgcttttcgccaaaggcccctcattgggcgtgcgcttactggtgctggtcgtgctttcggtcgcgctgatggtggtcgatgcccgctttgcactgctcaagcctgtgcgtagccagatgtcgctggtgttgatgcagacctactggatcaccgacctgccgcaacgtctctaccagggcgtggccagccaattcggcagccgcaccgagctggttgccgagaacgaaaaactcaagactgaaaacctgctgctgcaggggcgcatgcaaaagctggcggccctcaccgagcagaacgttcggctgcgcgagttgctcaactcttcggcactggtcaacgaaaaggtcgaagtggccgagttgatcggcatggaccccaacccctttacccatcgcattatcatcaacaagggtgaacgcgacggcgtggtcctcggccagccggtgctcgatgcccgtggcctgatgggccaggtggtggagctgatgccctacacctcgcgggtattgctgctgaccgacacgacccacagcattccagtgcaggtcaatcgcaacggtttgcgtgcgattgccagcggcaccggtaacccggaacgcctggaattgcgccatgtggccgacaccgcggatatcaaggaaggcgatttgctggtcagctccggtctgggccagcgtttcccggccggctacccggtggcgacggtcaaggaagtgatccacgattccggccagccgttcgctattgtgcgggccgtgccgactgccgcgctcaatcgcagccgctacctgttgctggtgttcagcgacaaccgcaccccggaagagcgcgccaacgacgccgcccaggcccaggaggcggaagacaagcagaacggcactgtgccggtcgtgccggccacggtgccgaaaccggcgttcgttggcccgccagcccctgctaccgtacccgcagcggcggcgcctgttgcaacgccggccaaaccggctacgcataacgctcgcccagccaagccggctgcgtctaaaccgccggccacgacgccaaccgccactgcggcccccacacggcagagggaggaataatggctagtactcattcgcgtaatggctggatcgtctggctgaccttcgccattggcctgttactcagcgtttcgccactgccgcaattcatggaaatcctgcgcccgctctggctggccttgctgttggcgttctggtcgctgaacctgccgcacaaggtgggcatggtcacggcgatgtgcctgggcttggcggaggatgtgctctatggcaccttgctgggccagaacgcgttgatcctgaccctgattaccttcctggtgctgtcgttgcagcagcgcttgcgcatgttcccgatgtggcagcagtgcctggtgatcctggtgatcttcggcctggcgcagttggtccagttgtggctcagtgccttgaccggcaatcgccagccgaccctggcgttggtcttaccggccctggtcagcgcattgctgtggccctggatcagttttggcctgcgtgggctgcgccgtcgctataaaatcaattgaatggttgcgaggctctgcctggttatcaaaccccacagggagaggctgcaatgaattcgctttatctggcctcgggctccccgcggcgacgtgagctgttgaaccagatcggtgtgcctttcaccgtggtcagcgccgctattgatgaaacacctcttacccacgaacccgccgttacctatgtcgagcgtcttgcgcgcggcaaggcaacggcgggttttgttgcgcttggccaaccttcgggcgcctgcgtattgggcgccgatacggcggtgattattgacggccagatcctgggcaaacccgtggaccaggccgatgcgctggcaatgctgatggccctttccggccgcgagcatgaagtgctcactgcgattgccctcaccgacggccagcgctgcgaaacccgatatgtaagcagtcttgtacgttttcgccaggtttctgtcgaagaggctacaacctactggcacagtggcgaaccccaggacaaggccggcggctatgctatccagggcctgggttcggtgttcgttgccggcctcaatggcagttattctgcggtggttggcctaccggtgtgcgaaaccgcgcaactgctcgcccaattcggcataccctgttggcaaaaccttaccgtgcgctgaacgccgtattccagcgccaagccttgagcgaccggtcactattgtgaaaacgcctgaacgagacccagccatgagtgaagagattctgatcaatatcacgccgatggaatcgcgcgtggcggtggtagagaacggtgttctgcaagaagtgcatgtggaacgcacccagaagcgcgggatcgtcggcaatatctataaaggcaaggtggtgcgcgtattgccgggcatgcaggcggcattcgtcgatatcggcctggaccgtgcagcattcatccatgcttcggaaatttccctgcgtgaaggcccggcagtggaaagcatcagtgccctggtgcatgaagggcagagcctggtggtgcaagtcaccaaagaccccatcggttccaagggcgcacgcttgaccactcagctgtcgattccatcgcgctacctggtgtacatgccgcgcaccgcccatgtgggcatttccctgaagatcgaagacgaagccgagcgcgaccgactcaaaaaggtggtcagcgattgcgtcgccgctgagggcatcaaagaagcgggtggttttatcctgcgtaccgccgccgagggcgccggagctgatgaaatccttatggatatccgctacctgcggcgcctgtgggaccagatcgacgcacagatcaagaccatcggcgctcccagcgtgatttatgaagatctcggcctggcgctgcgcacgctgcgtgacctggtcagcccgaagattgagaaaatccgcatcgactcgcgggaaaccttccagcgcactacacaattcgttgccgagctgatgccggaaattgccgaccgcctggagcattaccccggcgagcggccgatcttcgacctgtatggcgtcgaagacgaaatccagaaagccctggagcgcaaagtgccgctcaagtccggcggctatctggtggtggacccggccgaggccatgaccaccatcgacgtcaacactggtgcattcgtaggccatcgcaaccttgaagagaccatcttcaagaccaatcttgaagccgccaccgctatcgctcgccagctgcgcctgcgcaacctcggcggcatcatcatcatcgacttcatcgacatggaagatgaagagcaccagcgccaggtgctgcgtaccctcgagaagcagctggagcgcgatcacgccaagaccaacatcatcggcatcaccgagctgggcctggtgcaaatgacccgcaagcgcacccgcgaaagcctggagcaggtgctgtgcgagccgtgcagcagttgccagggccgcggtaagttgaagacgccggaaaccgtttgctacgagattttccgcgaaatcctgcgcgaggcgcgcgcctaccaggccgaaggttatagagtgcttgccaaccagaaagtggtcgatcgcctgctggacgaagagtccggcaacgttgccgagctggaaagttttatcggtcgcacgattcgcttccaggttgaaaccatgtattcccaggaacaatacgacgtggtgctgctctgatccccaattgcgtgttttatccgagaccggcagaccttgatctgccgtccgccaactgttttttgagggtcgcctgacatggagcgtctgatacgcttttttgccgctttgacccgctggggcctgggcctgtgcgcgttgctgctggtattggcggcggtatacgtgagcctggggcgtgagttgagccctctggtggctgaataccgcgccgaaatcgaagccaaggcccaggccgccgtggagacgcctttgcatatcggcagccttgaaggccgttggagcgggtttgccccggtattgctggcccacgacgtcatggtcggcgagggcagcagtgccttgcgtcttgaccaggtggaggttgtgccggatatgtgggccagcctgatggcccgtcaagtgcgtatcgcccacctggaagtcagtggcctgcaactgagcgtcaaggaagacaaggatgggcgctggacgctgcaaggcttgccggtgcaggacgaccagccgctggacccgcagcagttgctgacgcgcatgcaaatggtcaagcgcgtgtcggtgctggacagccaggtcaccttgcaacccttcgaccaggcaccagtgaccgtaacgtacgtgggcctgagcctgcacaccggcatgagccaacagcgcctggatgcacgcctgaccctgcccgacggccaaccgcttgctgtcagcctgcgtagccacatccgcgccagccaatggaaagacgctgaggtcgatgcctatctgagcttgccgcaaagcgactgggccaagtggattcccgccaaactgacccggcaatggaagctcactcagttcaaggccggtggcgagttttggctcagttgggccaaaggcaccgtacaaagcgctgcggtgcgcctcaattccccgcaagtgaagggcaactacgccgaccgcaagcctgtgcatctggaaaacctggccctgaccgcctacctgcaacgcagcgacagcggcctcaaggtgctgtttgattcgctggcgatgactatcggtgagacccgctgggagtcgcgcctgcaattacagcagagcctggcgaccgataaggctcaggaagtgtggaacctgcaggccgatcgtctcgacctgacacccatcacgccactgctcaatgccttggcgccgttgccggaaggctttgccaagaccgtcgagcacttgaaggccacgggcctgctgcgcaatgtgctggtggacttcagaccccaggacaccaccgaccagaaagtcagttttgccgcaaaccttgagcgtgtaggcttcgacgcgtatttcggcgcgccggctgcgcgcaatgtgtctggcagcatcagtggcgacctgggccatggcgagctgcgcatggacagcaaggacttttccctgcacctggacccgatcttcgccaagccctggcagtacatccaggccaacgcacgcctgacctggaaactggataaacagggtttcaccctgattgccccgtatatcaaggtgctgggggaggagggcaaggttgctgcagacttcctgatccgcctgcacttcgatcatagtcaggaagactacatggacctgcgggtcgggatggtcgatggcgatggccgtttcacccccaagtacctgcccgccgtgttgagcccggcgctggatgagtggctgcgtacggcaatcctcaagggcgccgtggatgaagggttcttccagtatcaaggctccctgaaccacgacgcgctgccggcgtcgcgcaacatcagtctgttcttcaaggtgcatgatgccgagttggccttccagccgggttggccccatgttgacaaggtcaacggtgaagtcttcgtcgaggaaagcggtgtgcgcatcctggcaagcaagggccagttgctcgatacccaggttaaggacgtctacgtcaacattcctcacgcgccggccggccaggacagtcacctgctgctcactggcgggttctccggcggcttgggcgatggcttgaaaattctccaggaagcgcccattggcaccgcgtccacgttcgctggctggaaaggcgagggcggcctgcagggcagcctggacctggacgtgcccctggccaagggcaccgagcccaagatcgtggttgacttcaagaccgacaaggcgcgcttgcaattggccgagccgaccctggacctgacccagctcaaaggcaatttccgttttgacagtgccaagggcctgagcgggcagaacatctcggcccaggccttcgaccggccgatcactgcgcagatttttgccgaaggcaagccgggcgatatcagcacccgcgtgaccgccaacggccaggtaacggtcaagcgcctcacggattggttgaacgtcagccagccactgccggtgtccggggatatcccgtaccagttacaagtcatcctggacggcgcagacagccagttgatggtcaactccaatctcaagggtgtcgccgtggacttgccggcgccattcggcatgccggccagccaggggcgcgacagtaccttccgcatgaccttgcagggggctgagcgccgttactggtttgattacggcgagctggcaaacttcacctttgctgcgccgccggacaaattcaatgacgggcgcggcgaattgttcctcggcaatggcgatgccgtgctgcccggtgcaaagggactgcgcattcgtggtgtgttgtcggaactggatatcgacccgtggaaaaaactcgtggatcgctacgcggggaatgacccgggcggcaatgccaagcagttgctcagtggcgccgatttcaaagtgggcaagttgaccgggttcggcacccagtttgaccaggtcagcttacagctgggtcgcaagaccgctgcctgggggctgcaatttgatagccagcaggccaagggcacggtgaatctgcccgacgccaacggtgcgccgattgcggtcaacctcaactatgtaaaattgccagcagtggacccgacggtacaggcggacgaaaacgcgcccgatccgctggccgatatcgaccccaagagcattccggcactggatatcgccatcgaccagctcttccaggggccggacttggtgggggcgtggtcattgaagatccgtccgaccgccaagggcatggccttcaataacctcgacctgggcctcaagggcatgcagctcaagggtgccggcggctgggaaggggcgccgggcgccagcagcagttggtacaagggtcgcctggacggcaagaacattgccgatgtgctcaagggctggggttttgccccgacggtgaccagcgaagatttccatctggacgtggatggccgttggccgggttcgccggcctgggttgggcccaagcgcttctccggcagcctggatgcggcattccgtaaaggccagttcgtcgaagtggaggggggcgcgcaggcgttgcgggtgtttggcctgctcaacttcaattccattggccggcgtttgcgtctggacttttccgacctgcttggcaagggcttgagttacgaccgggtcaagggcttgctggccgccagtaatggcgtgttcgtgacccgtgagcccatcaccatgaccgggccctctaccaatctggagctcaacggtaccctggacctggtggctgatcgcgtcgacgccaagttgctggtgaccttgccggtgaccaacaacctgcccatcgcggcgctgattgtcggtgcaccagctattggcggcgcgttgttcctgatcgacaaactgatcggtgatcgggtttcgcgctttgccagtgtgcaatacaaggtacagggcccctggaaggatccgaaaatcaccttcgacaagccatttgaaaagccaaactgagagcctgtggagtagcatggccccatgccctgtatggagtgtcggcccatgtcttttgcagtaatccaaatggtcagccagagtgacgtgctggctaatctcacccaggcgcgccgcctgctggagcaagcggcggcgggtggcgcgaaactcgcggtactgccggaaaacttcgctgcgatgggtcgccgtgacgtggccgatatcggccgcgccgaggccctgggtgaaggcccgatcctgccatggttgaaacaggccgcccgtgacctcaccttatggatagtggccggtacattgccgttgccgcccaaggaccaaccccacgccaagtccaacgcttgctcgctgctgatcaatgatcagggtgaaattgtcgctcgttacgacaagctgcacctgtttgatgtggacgtcgcggatgctcgtggtcgttatcgcgaatccgacgactatgctttcggaagcaatgtggtggtggcggatacgccagtggggcgtttggggctgacggtgtgctacgacttgcgcttccccgagctgtatagcgaattacgcgctgcgggggctgaattgattaccgcgccctcggcctttacggcggtgaccggggccgcccattgggatgtgctgattcgggcgcgggccatcgaaacccagtgctacctgctggcggccgctcaaggtggcgtgcacccaggcccacgggaaacccatggccacgcggcgattgtcgacccttgggggcgggtgctggcacaacaggatcaaggcgaagcggtgttgctggccgaacgcgatagcagtgaacaggcgtcgataagggcgcgcatgccggtggtcagccatcggcgctttttctcgcagggcgcgcagcggcctgcttcagaacgatgaatttaaggccaaacctatgagcgagttgttgtcctcagtcagtgaacacctcctggcacccggtggcgtgaccatcgaaagtctgcaaaccgtgctgggcgatctggccgggccgggcatcgatgccgccgatctgtatttccaggggcagatctccgaatcctggtcgctggaagacggcatcgtcaaggaaggcagtttcaatcttgaccagggcgtcggcgtgcgtgcgcaatccggtgaaaaaaccggctttgcctacagtaatgcgattaccctggaagccctgggcctggcggcgcgtgcggcacgttcgatttcccgtgccggccagaacggtacggtgcaggcgttcagcacccaggacgtgacgcagttgtacgcgccggataaccccttggaagtgatcagccgtgccgaaaaggtcgagctgctcaagcgtgtcgacgcggccacccgcgccctggactcgcgtatccagcaagtgaccgtgagcatggctggcgtgtgggagcgcatcctcgtcgcctccaccgacggcgggttggcggcggatgtgcggccgctggtgcgtttcaatgtgagtgtgatcgtcgagcagaacggtcgccgcgagcgtggtggccatggcggtggcgggcgcaccgactaccgttacttcctcgctgacgaccgtgccatgggctatgcccgtgaggcgctgcgccaggccctggtgaacctggaagcgattccggcgcccgccggtaccttgccggtggtgctgggctcgggttggtccggcgtgttgctccacgaagccgtgggccacggcctggagggcgactttaatcgcaagggcagttccgcctacagtgggcgcatgggcgaaatggttgcatccaagctgtgcaccattgtcgatgacggcaccctggccagtcgccggggttcgttgagcgttgatgacgaagggacgccgaccgagtgcaccaccctgatcgaaaacggcgtgctcaagggctatatgcaagacaagctcaacgctcggctgatgggtgtggcgcgcaccggtaacggccgccgcgaatcctacgcgcacctgcctatgccgcgcatgaccaatacctacatgcttggcggccaaagcgatccggcggaaatcatcgcctcggtgaaacgtggcatctactgcgccaacctcggcggtggccaggtggatatcaccagcggcaagtttgtgttctccaccagcgaggcatatttaatcgaagacggcaagattaccgcgccggtcaaaggggcgacgctgatcggtaacgggccggaagcgatgagcaaggtgtcgatggtcggtaatgacctgtcgctggacagcggcgtgggcacgtgcggcaaggatgggcagtcggtaccggtaggcgtaggccagccaaccctgaaaattgacgcgattaccgtgggtggcacggggtcgtaaaggatggagcttcgggtggcgcaggccgccacccggggaagaggatcagcgcagaccgcgttgagtctcgtccagctcacgaatgtacttgaagattttacggctggtggccggcgccttgttatgcgccagttcgtgttgggcctgacggatcagggagcgcagttgctggcggtccgcgtccgggtagtccagcacgaatttctccagcacggcgtcatcgcccgcgatcaggcggtcacgccaacgttccaggttatggaagcgttcgttgtactggcgagtggaggcatcagtttgatcgagcaaggccagaatcgcgtcaatgtcctgatcgcgcatcagtttgccaataaacatgatgtgccgtttacgcgcgatattcgcgctgtgtttgggcgcatccgccaaggcccggcgcatttcgtcggtcagtggcagtttggcaatcaactcttttttgagcgttgtgaggcgctcgcccaggtcaaccagcgcatgcagctcgcgcttgacctgggttttgcttttctccccatcgagggagtcgtcgtaagaatcaaccatggtggcagtccgcaaagaaacgccgccatgataaccagtcgggggccgcttgtccggcccggtcgctcgatggccttaaccgaaagcagaatttgagtggagaaaaccatgagtgcagcccaaagcgtcggtccgcaagcgttaccggcactgcaggaacaagtcgagcagatccttgccgaggccaagcgccagggggccagtgcctgtgaagtagcggtgtcgctggagcaggggttgtcgacgtcggtgcgccagcgagaagtggaaactgtcgagttcaatcgcgaccaggggttcggtatcaccttgtacgcaggccagcgcaaaggctcggcaagcacctcagccagtggcccggaggccattcgcgagaccgttgccgcagcactggcgattgccaggcacacgtccgaagatgaaagctcggggctggccgataaggcgctgatggccagggacgtacaggattttgacctgttccacgcctgggacatcacccccgagcaagccatcgagcaggcgctggtctgcgaggcggcggccttcgataccgacgcccggatcaagaatgccgacggcactacgctgagcacccaccagggctgccgcgtttacggcaacagccatggctttatcggtggatatgcttcgacgcgtcacagcctcagttgcgtgatgatcgccgaagccaacggccagatgcagcgcgattactggtacgacgtgaatcgccagggcgatttgttggcggaccccgtcagcattggccagcgtgctgcgcaacgtgccgccagccgtctcggtgcgcgcccggtgccgacatgcgaagtgccggtgctgttttccgcagagctggccggtggtttgttcggtagcttccttggcgctatttccggcggcaacctgtatcgcaagtcttcgtttcttgaaggcgcaatcggccagaagctgtttccagagtggctgaccatcgacgagcggccacacctgatgcgggccatgggcagttcgtcgttcgacggcgatggcctggcgacctatgccaagccatttgtcgaaaagggcgagttggtctcctatgtattgggcacttatgccggtcgcaagcttggcctgccaagcaccgccaactccggcggcgtgcataacctgttcgttacccatggtgatgaagaccaggctgcgttgctgcggcgcatggggcgtgggttgctggtcaccgaattgatgggccacggcctgaatatggtcaccggtgattactctcgcggcgcggcggggttctgggtggaaaatggcgagattcagttcgccgtccaggaagtgacgattgccggcaatatgcgcgatatgttcaagcagatcgttgccgtgggtaatgacctggaactgcgcagcaatattcgcacaggttcagtgctcatcgagcggatgactgtcgctggcagctaacccccctccagcactcaataaaaggcgcgccatcctttggatggcgcgccttttttatggcttggtcatgggaggatcaacctgccgctcttgttttgattctcaatatcatttaataataaatatcattaccgagtgagtgtggatcatgagttctgtcctgcatgaggatccttacctggaaagctggcgttggatgagccgccagattcgctgcggcctcgatcccgatgaaccgcggctgatcgagcattacctcaatgaaggtcgatacctggcgtgttgcaccgcgacccatccgtggacgatcgccgaaacctcattccgcctgttgatcgacaccgccagcgatatcgcgctgccctggcattggcgctccatgtgcctggaccaggcctggcgcccgctgcgcgacctggaacgactctcccattgcccctgccgcctcaagcgctggcagtcctttgcctggcaactggcgacttgccaattgctgccctccatttctgtgtctgaccttgtgcaaggatcttccgatgagtaatacccgtatcgaacgcgacagcatgggcgagttgaaagtcccggcagaagccttgtatggcgcccagacccagcgtgcggtgaacaattttcccatcagtcatcaacgcatgccggcgcaattcattcgcgccctgatcctcgccaagaccgccgcggccaaggtcaacgttgacctcaagcaaatcagcgaagggcagggcaaggccattgtcgatgctgcccaaggcttgctggaaggcgactacatgcagcacttcccggtggacatcttccagaccggttccggcaccagctccaacatgaacgccaatgaagtgattgccacccttgccagccgtttgctcggcgagacggtcaaccccaatgaccacgtcaattgcggccaaagcagcaacgacatcatccctaccaccattcacgtcagcgcagcgttggtcctgcatgaacaaacgctgccggccctgctgcacctggtgcgggtgatcgagcaaaaggccgaggaggttcacccgttcatcaagaccggccgtacacatctcatggacgccatgccagtacgcatgagccaggtgctcaatggctgggcgcagcagctcaaggccaatatcggtcacttgcaagacctgcttgcggccttgcaagcgctggcccagggcggtaccgccgtgggcaccgggatcaacgcgcaccccgagtttgccgggcgtttcagccagcaactgagccgcttgaccggggtgaagttcactccaggcacgaatctgtttgcgctgattggctcccaggacaccgccgttgccgtctctggccagttgaaagccacggccgtctcgctgatgaagatcgccaacgacctgcgctggatgaactccggcccactcgccggcctcggtgaaatcgagctggaaggcttacagccgggctcgtcgatcatgccgggcaaggtcaacccggtgatcccggaagccacagccatggtagccgcccaagtcatcggcaatgacacggtgatcaccgtggccggtcaatcgggcaacttcgagctgaacgtgatgctgccgatcatcgcccagaacctgctcagcagccttgaattgatcgccaattccagccgtttgctggcggacaaggccattgccagtttcaaggtcaacgaggccaagctcaaggaggcgctgtcgcgcaacccgatcctggtcaccgcactcaacccgatcattggttaccaaaaagccgctgaaatcgccaagaaggcttatcagcaaggccggccggtgatcgatgtcgccctcgagcacaccgacctgccacgcagccaactggaagtcctgctggacccggagaagctcacggccggcggcgtgtaaccaacgaccctgctttggaggctcactatggagcactggaaacgcacgatcgaacgagccaatcgctgttttatggcgggcgagctggttgacgcccgcgaggcctatctgcaagccctggccctggcccaagtgttgttcgaacgctgggcggatgccgacgaagcagtggcggcttgcgtcatttcccatcacaacctggcggacttgcacttgcgcctgaaccaaccagaggaaagcgcggaatacctctgtgccatccaccagcgcctgttgcagaccatgcaggacccacgcctgaacccgcaattacgcgaggcagcattgcgccagagcagcaagacctatgtcgaactgttgaacttcatcagcgatcacggcgagtacccgcgtacccatcgcttgttgggcgctgctgcgccgcaatcgtccacgtctcaatacggagcacattgatatgacctataccttgccggccttgccttacgcctacgacgccctcgagccgcatattgatgcgcaaacaatggagattcactacaccaagcaccaccagacctatatcaacaacctcaacgctgcagtcgagggtactgagtttgccggttggccggtggaaaagctggtgtccagcgtccagcaactgccggaaacgctgagggccgcggtgatcaatcaaggtggcgggcatgccaaccattcattgttctgggccgtcatgtcgcccaacggcggcggtaagccagaaggtgcgctgggtaatgctatcgacgaacaactgggcggctatgatcgtttcaaggaagccttcaccaaggcagccttgacccgcttcggcagcggttgggcctggctcagcgtcaccccgcaaaaaaaactggtggtggaaagcagcggcaaccaggacagcccactgatgactggcaatacgccgatcctgggcctcgacgtgtgggagcatgcttactacctgctgtaccagaaccgtcgcccggaatatatcaatgccttctacagtgtcatcaactggccggaagttgccgcacgctaccaggccgccctggcctgaaattcctccataacaagatctaaggccgactatgggcactgaaacactggcgatcagtagcgtgcgaatgtttcgttatgcgtttggctcgctgttgctattggctggtaccgcgttgctggtggcccacgggctggcctggcttaacctggagccccgcatcctgcgcgctttgcagggaggcgcgatttgcgcgctcggcacggcgctgggggcggtgccagtgctggtgattcggcgcatgccgatagcgctgagcgatacccttttgggtttcggtgccggtgtgatgctggcggcgaccgctttctcccttgtggtgccgggtatcgccgcgggtgaaagcctggggctctcgccctggggggcgggtgggttgatcagcttcggcattatgctgggggcgttcggtctgtacctggtcgatcgcaaggtctccggtgccagcccggaaatgctggtgggcacaccggataaaccagtgatcccgccgcgcatctggctatttgtgtttgccatcatcgctcacaatattccagagggtatggctgtgggtgtctcggcgggtggtggcatgccggatgccgatagcctggccatgggcattgctttgcaggacgtaccggaaggcctggtgattgcgctggtgctggctggggcggggatgtcgcgggtcaaagcgtttctgatcggcgcggcgtcaggcttggtcgagccggtattcgcggtactttgtgcctggttggtgagcctggccgaggtgctattgcccttgggcctggcgctggccgccggtgcgatgctgttggtggtgacccacgaagtgatccccgaatcgcggcgaaatggtcacgaaaagctcgccagcctcgggctgtgtatcggtttttgcctgatgatggtgatggatacggcgttgggatgaggctccctgctacttaaaaggttattcgccttcgtcgaagtagttattgatcaactcaaccaatgccgccatcgcttcgtcctcttgctcgccttcggtcttcaggtgaatcttggtgcccttgccggccgccagcatcatcatcgccatgatgctcttgccatcgaccatggattccggtgtacgaccagcgcggatctgacaagggtactgcccggccacgccgacgaatttggccgaggcccgggcgtgcaggcccaacttgttgatgatttcaatttcccgagccggcatcgcagtggtgttcctttcagctaaggtcgcggtggcggacctggacgttcttgagggtttgttgcagcacctggcccagccgttccgtcagatagacggagcgatggtggccgccagtgcagccaatggcaatggtgacgtaggcgcggttgctcgcggcaaagcgcggtaaccatttgagcaggtagctggagatgtcctggaacatctcttctacatccggttgcgcggccaggtaatcgaccacgggttggtccaagccggattgatcgcgcagttccggcttccaataggggttgggcaggcagcgtacgtcgaacaccaggtcggcatccaccggcatgccacgtttgaaaccgaatgattcgaccaggaacgcagtcccgggctctggctggttcagcaggcgcagcttgatcgcgtcgcgcagctgatacaggttcaggttggtggtgttgatcttaagatcagccagatcaatgatcggcccgagcagcttggtctcgtcctggatggcttcggccagggagcggttggcgctgctgagcgggtggcgacgacgggtttctgagaagcgtttgagcaacgtttcttcgtcggcatccaggtacagcacatcgcaatgaatatgcttggcgcgcacttcttccagcagttccgggaaccgcgagaggtggctgggcaggttgcgggcatcgatagacacagcgaccaggggttgcgccagttcagtatggatcagtgcgcgttccgccagctccggcagcaggccggcgggcaaattgtcgatgcaatagaaaccgttgtcctcaaggacgttgagggcggtgcttttacctgagccggaacggccgctgacgatgatcaaacgcatgattactgcccgttttgttcatccaggacgacctgatacagggcctcgttggtcttggcactgcgcagtttttcgcgtacctccttgcggtcgagcatgctggcgatctgccggagcagttccaggtgcgcatcggtggcggcttgcgggaccagcaatacgaacagcaggtcgaccggggctccgtcgatggcgtcaaaatcgatggcagcttccaagtgcagcagggcgctcacgggcgtatcacagcctttgaggcggcagtgagggatggcgatgccgttgccaaaaccggtggaaccgagcttttcacgggcaatcaacgcctcgaagacatcttgcatctccagacccggcacttcgcggtggatcaggttggcaatttgttcgagggcttttttcttgctgccgcccggcgcgttcacgagggaacggccgggggtcaggatggtttcaagtcggatcatggggggagagttaacgacctgtgccttggagcaggctcagattcttttccttatgctttttgagttggcggtcgagcttgtcggtgagcaagtcaatcgatgcatacatgtcttcatgctcggcattggcaaccacttcaccaccaggtatctggagggtcgcttcgatcttctgctgaagcttgtcaaccttcatgatgacctgcacgttggtgatcttgtcgaaatgtccttcaagcttcctcagcttctgctcgacatagtcgcgcagtggaggggtgacttctacatggtgtccactgatgttgacttgcatacagcttctccttcgttgccagtgcataaagcggcaggcaagacgcctgccactggaacgctatggcccgcccgtcacatcaaacgcttacgctcgctggaaggcgcgatcccgagggactcgcggtacttggcgacggttcgacgggcgacctgaatgccttgtgcctccagtaaaccagcgatcttgctgtcactcaacggctttttctgattttccgcggcaaccagtttcttgatgatcgcgcggatcgccgtggacgagcattcaccgccttcggaggtgctgacgtggctggaaaaaaagtatttcagctcataaataccccgtggggtatgcatgaatttctgcgtggtcacccgggaaatcgttgattcatgcatgcccaccgcttcggcgatatcgtgcagtaccaaaggcttcatggcttcgtcgccatattccaggaagccgcgctggtgctcgacgatctgggtcgccactttcatcagggtctcgttgcggctttgcagactcttgatgaaccagcgggcttcctgcaactggttgcgcatgaaggtgttgtcggcgctggtatcggcgcggcgcacaaaaccggcatattgcgggttgacccgcaggcggggcaccgactcctgattcagctccaccagccaacgctcgttgtccttgcgcacaatcacgtcggggacgacgtattcggcttcgctggactcgatttgcgagcccgggcgcgggttgaggctctgcaccagctcgatgacctggcgcaattcatcttccttgagcttcatgcggcgcatcagctggctgtagtcgcggctgcccagcaggtcgatgtagtccgccaccaggcgcttggcttcggccagccagggcgtcttggccggcaactgacgcaattgcagcagcaggcactcgctgagggtgcgggcgccaatgccggcgggctcgaattgctggatgcgatgcaggacggcttcgatttcgtccagttcgatgtccagctccgggtcaaaggcttcaagaatctcgtcgagggtctcgtccaggtagccctggttattgatgcagtcgatcagggtgaccgcgatcaggcgatcagtgtcggacatcggtgccaggttcagttgccacaacaaatggctctgcaggctctcgccgacagatgtacgggtggtgaagtcccactcgtcatcgtcgttgctcggcaggctgctggcgctggtctggtacacgtcttcccacgcggtatccacgggaagctcgttgggaatgcgttcgttccattcgccatcctcgaggttatccaccgtcggggcggtttcctggtaggagggttcctgcacgtcgggattgggtttttgctcgatgttatcggccagagggtcggcattgtcgaagtcgtcgccttcttcctggcgttcgagcatcggattggactccagggcctcctggatttcctgttgcaggtccagggtcgacaattggagcaggcggatggcctgttgcagctgcggtgtcatcgtcagctgctggcccattctcaggactagcgatggtttcatggcaggggcttaacaccttattcgccggcgcaatgcgccatccacgacagggcgcgtgagcgccaaacataagcaaattatatgcctgatctcgggggctttgcctagagcgcggtaacaataaaaaagctaaggtttctattgactcctgcgcgctccaggtaaagccgcgataccaccgtgcctacaggcggaactcgtgacccaggtacacttccttgaccagctcgttggccaggatagtctcggcatcgccttcggcaatcagttggccgtcgttgacgatataagccgtttcgcagatatcgagtgtctcgcgcacgttatggtcggtgatcagcacgccaatgcccttggccttgaggtggtggatgatctgcttgatatcgcccaccgagatcgggtcgacaccggcaaacggttcatccagcaggatgaacttgggcgcggtcgccagggcgcgggcgatttccacacgacgacgctcgccaccggacaggctcatgccgaggttgtcgcgaatgtggttgatgtggaattcctgcagcaggctttccagctctttgcggcggccatcgcggtcgagctccttgcgggtctccaggatcgccatgatgttgtcggccaccgacagtttgcggaagatcgacgcttcctggggaagatagccgatacctgcccgcgcacgaccatgcatcggctggtggctgacatccaggtcgtcgatcagcacacgaccctggtccgcctggaccaggccgacgatcatatagaagcaggtggtcttgccggcgccgttggggccgagcaggccgacgatctggccgctgtcgatcgacaggctgacgtcgcgtaccacctggcggcttttataggccttggccaggtgctgggctttcagggtcgccattactcggccttcttcttcggctggataaccatgtcgatacgcggacgaggtgcggtgaccttgttgccattggcgcgaccggcctgggcgacctgggtctgggtgttgtagacgattttctcgccttcggtcgagttaccgtcggcgctcagcaccttggcctggtcgatcagtacaatgcgattttgctgggcatggtattgaatggtcttgccgtagcccttcatcgggcctggatcttctgccttctgcttctgttcgaagtaagcgaggttgcccactgaggtcacgacatcgatatcgccggcctgggtacgcgtcagtgtcaccgtattaccggtgatcttcatcgagccctgggtgatgatcacgccgccggtgtaggtggcgacaccttgcttgtcatccagctgcgcatcgtcagccgagatatggatcggttgctggctatcgttcggcagagcccaggcgctcacgcttcccagtgctgcgcccagaccgagcaaaatagggagggttttaacgagcctcatactgtcctcttacgttcgatagcaggtgtatcctgctttctttcaaatacgctttcattcccttgccagtcgatacaccgccagcgccgtcgattctaacgtcttgctcggtctgcgcatattgcttctgtgggaataccgtcatgcgactgctggtaatgatggtgtcgcggttctgtgcgtctgtacgtgcgacgcgcaccgagtcgatcagttcaacttcggtgccgtccgggttgacctcgccacgcttgctggtgacgtgccacggaaattcggtgccgcgatacaggttcaggtccggattggtcagcaggctgacttcggaggccttcaagtgctcgaccttgtccgacgtcatttcatactgcaccttcccgtcgggcaggtactggatgctgtaggcattggtggcgtaatagtcgataagaccttcgtcaacctgcgcaaccggctggtcgagaaagcgccccgggctgatattccagtagcccaccgccaagagcagcgcggcgatgaccccgaataacaggaagttgcggatctttttactcagcatataacgctctataggtaggcggcgtgggccgcttcaagactgccctgggcacgcaggatcaactcgcagaactcccgggcagcaccttcgccgccacgggcggtggtgatgccgtgggcgtgttcgcgcacaaacgccgcggcattcgcgacggccatgcccaggcccacccggcgaatcaccggcaggtcaggcaagtcgtcacccaaataggcgacctgttcatagcttaggttgagttggccaagaagctcgtccagcactaccagtttatcctcacggccctgatacaggtgagcaatccccaggttttgtgcgcggcgttccacaaccggtgtctttcgaccgctgataatcgccgtttgcacaccggccgccatcagcatcttgatgccctggccatcgagggtgttgaacgtcttgaattcgctgccatcttcgaggaagtacaggcggccatcggtcagcacgccgtcaacgtcgaaaatcgccagcttgatgtttttaccgcgttgcaacaggtcgccgttcatctacatcactcctgcgcgcagcaagtcgccaaggttaagggccccgatagggcgatcatcattgtcgacgacgatgagcgcgccgatccggtggtcttccatgattttcagcgcctcagccgcgagcatttcagcgcgggcggtcttgccgtgaggcgtcattaccgcatcgatggtcgcggtgtggatatcaatggtgcggtccagggtacgacgcaggtcgccgtcggtgaataccccggccaggcgaccatcgggttcgacgatcgccgtcatgcccaagcctttgcgggtcatttccatcagcgcatccctgagcagggtgccgcgtgggacgcttggcagttcggcgccggaatgcatgacattttccactttaagcaacaggcgacggccgagcgcgccgcctgggtgggaaaatgcgaagtcttcggcggtaaaaccgcgggcctccaggagcgccacggccaatgcatcgcccatgaccagcgcagcagtggtggaggaggtgggcgccaggttcagcgggcaggcctcgtgggtcacgtgcacgttcaggttgacatcggcagccttggccagcgtcgattccgggttgccggtgaggctgatcatctggatgcccaggcgcttgatcaggggcaacagggtcacgatttcgttggtggtgccggaattggacagcgccaggatcacgtcatccttggtgatcatgcccatatcgccgtggctggcctcggccgggtgcacgaaaaacgcggtggtcccggtactcgccagcgtcgcggcgattttgttgccaatgtgaccggacttgcccatgccgaccacgacaacgcggcccttgctggtcaggatcagctcgcaggcgcgcacgaaatccgcgtcgatatgggccagcaagccctctacggcttcaagctcgaggcggatggtgcgttgtgcggattggataagctcgttggattggctcatgtctgaatcgtatagcctgacgaaaagtcggcgattatagccgtaatgatcaatacgctcacgtaagttcgtcagggtttgtgcgcgaggtacatgaaaatcaccgtccttaacatagcaggcaacgtttttcccctgtctcaaatctgaacgagcgctgttccggccttgggggctctgcaccagcagtgatatagttcgccgccagttcggtccacccaacccatgtgcctaactattgcgcatcctttgcaaaccaaagtcgcacacatggtgtctgagtgaaaggctgcatcccaaggagattagatgagtgccgataacgcctacgcggtcgagctgaagggtctttccttcaagcgcgggacgcgcagcatcttcaataacgtcgatattcgcattcctcgcggcaaggtcacgggcatcatggggccttccggttgcggcaagaccaccctgttgcgcctgatgggcatgcaattgcggcctagtgcgggcgaagtgtgggtcaacggtcagaatctgccgaccctgtcgcgcagcgatctgttcgatgctcgcaagcatatgggcgtgctgttccagagcggcgcgctgttcaccgacctcgatgttttcgaaaacgtagccttcccgctgcgggtgcacacccagctgtccgatgaaatgattcgtgacatcgtgttgctgaaactgcaggccgtgggccttcgcggtgccatcgacctgatgccggacgaattgtccggcggcatgaagcgccgtgtcgcgctggcgcgagccatcgccctcgacccgcagatcctcatgtacgacgagccgttcgttggccaggacccgatcgccatgggcgtgctggtgcgcctgatccgtctgctcaacgacgcactggggatcaccagtatcgtggtgtcccacgatttggccgaaaccgcgagcatcgccgactacctgtatgtagtgggcgatggccaggtgctggggcagggtacgcctgaagagttgatgaacgccgataacccgcgcattcgccaattcatgaccggcgatcccgatggcccggtgccttttcactttccggcagcggactaccgctcagatcttctggggaagcgctgatgcgcaagacatctcttatcgagaaggttcgccttttcggtcgctcgggcatcgacatcgtcgaagtcctggggcgttcgaccattttcctgttccacgccctgctgggccgcggtggcatcggcggcggctttggcctgctgctcaagcagttgcatgcagtcggcgtgatgtccctggtgatcatcgtggtctccggggtgttcatcggcatggtgctggcgctgcaaggcttcaatatcctgtccagctacggttcggagcaggcggtaggccagatggtggccctgacgctgctgcgtgagcttggtccggtggtgaccgccttgttgttcgcggggcgtgcaggttcggcgttgactgccgaaatcggcaatatgaagtccaccgagcagctgtccagcctggaaatgattggcgtggacccgctcaagtacattgttgccccgcgcctgtgggccggtttcatttccctgccattgctggcgatgattttcagcgtggtgggtatctggggcggttcgtgggtggcggttgactggttgggcgtctatgacggttcctactgggccaacatgcaaaacagcgtcaccttcaccggtgacgtgctcaacggcatcataaagagcattgtctttgcctttgtggtgacctggattgccgtattccaaggctatgactgcgagcccacctcagaagggatcagtcgcgccaccaccaagaccgttgtgtacgcctcgctggcggtactgggccttgacttcattttgaccgccttgatgtttggagatttctgatgcaaaaccgcactgtggaaatcggtgtcggccttttcttgctggctggcatcctggctttactgttgttggccctgcgagtcagcggcctttcggccagccccaccgccgatacttataaactttacgcgtacttcgacaatatcgccggtttgacggtcagagctaaagtgaccatggccggcgttaccatcggcaaggtcacggcaatcgatctggaccgcgacagcttcaccgggcgagtgaccatgcagttggacaagaaggtagataacctgccgactgactccacggcatctatcctcactgcgggtctgctgggcgagaagtacatcggcgtcagcgtgggcggggaaacagccctgctcaaggatggttcgaccatccacgacacgcagtcgtcgctggtgcttgaagacctgatcggtaaattcctgctcaatacggtcaataaagacgccaaatgaggaatctgttcatgatctctaccttgcgacgtggcctgctggtactgcttgcagcgttgccgctgatggccaacgcggcaggttctgcgcacgatttggtgcaggacacgaccaaccggatgctggccgacctgaaggccaacaaagagcaatacaaacaagacccttcccgattctacgaagcactcaacacgattgttggcccggtggtcgatgccgaaggcatttccaaaagcatcatgacggtcaagtattcgcgcaaggcaaccccggcgcagatgcagacgttccaggaaaatttcaagcgtggcctgttccagttctacggcaacgctctgctggaatacaacaaccagggtatcgtcgttgaccctgccaaggaggagtcgggcgaccgtgccgaggtcggcatgaaagtctcgggcagcaatggcgcgatctatccggtgtcctacaccctgacgaaaatcaatggtgagtggaagctgcgcaacgtagtcatcaacggcatcaacatcggcaagctgttccgtgaccagttcgccgatgcgatgcagcgcaatggcaatgacctggacaagaccatcaacggttgggccggtgaagtggccaaggccaaggaagaaaccgacaaagctgccgggaagcctgcacaatgaccgagtcggctgttcgtatcggcgacgccggcgagctgttcctcagcggcgtgctggattaccgtaccgggcctgacctgcgcaagcagggccaggcgctgatcaaggccagcaaggcgcccgaagtggtactcgattgctcggcggtgaccaaatccagcagtgtcggcctgtcgttgttgctgtgcttcatgcgcgatgccgaggcggccaaaaaaccggtcagcatccgcgcattgcccgaagacatgcgtgagattgcccaggtttcgggtctgaccgagctgttggcgcatccttaagacacactttcaggaaagccccccgtcagagtcctgctatgcggggttcgcaggcgcggggcttttttgtatgatgtgcgacccgtgcgcactgggcgccgatagaggttgagcatgcaggccaacgaagttaaaagcttccttgaaggaaagctgcccgaaacgagcgttgaagttgaaggcgaaggctgcaacttccagctgaatgtgattagcgatgaactggcggcgttaagcccggtcaagcgtcaacagcagatctatgcccatttgaacccgtggatcaccgatggcagcatccacgcggtcactatgaaatttttcagccgcgcggcctgggccgagcgcacctgagcccccaaggcgtcgagattcttatggataaattgattattaccggcggtgcccgcctcgatggcgagatccgcatttccggtgcgaaaaactccgccttgccgatcctggcagcaaccctgctgtgcgatggcccggtgacggtggccaacctgccgcacctgcacgacatcaccaccatgatcgagctgttcgggcgcatgggcattgagcctgtgatcgacgagaaactgtcagtcgaaatcgacccgcgaaccatcaagaccctgatcgctccgtacgaactggtgaaaaccatgcgtgcgtcgatcctggtactcggcccgatggttgcccgtttcggtgaagccgaagtggccctgcctggcggctgtgccattggttcgcgtccggtcgacctgcatatccgtggcctggaagccatgggcgcgatcatcgacgtcgaaggtggctacatcaaggccaaggcgccggaaggtggcctgcgtggtgcgaacttcttctttgataccgtcagcgtaaccggtaccgagaacatcatgatggccgctgccctggccaaaggccgcagcgtgctgcaaaacgccgcacgtgagccggaagtggtcgacctggccaacttcctcaacgccatgggtgcgaaagtttccggtgctggcaccgacaccatcaccattgatggtgtagagcgtctgcacactgccacctacaaggtcatgccggaccgtatcgagaccggcacctacctggtcgccgctgccgtgaccggtggtcgtgtaaaggtcaaggataccgatccgaccatccttgaagccgtcctggaaaaactcaaggaagccggcgcagaaatcaccaccggtgaagactggatcgagctgaacatgcacggcaagcggccaaaggctgtcaacgtgcgcaccgctccatacccggccttcccgaccgacatgcaggcgcagttcatctccctgaacgcaattgccgaaggcactggtgctgtgatcgagaccatcttcgaaaaccgcttcatgcatgtgtatgaactgcaccgcatgggcgccaagatccaggtcgaaggcaataccgccatcgtcaccggcatcgacaagctcaagggcgcgccagtgatggcgaccgacctgcgtgcctcggccagcctggtgatctcggcactgtgcgccgaaggcgacaccctgatcgaccgcatctaccacatagaccgtggctacgagtgcatcgaggaaaaactgcagatgctcggcgcaaaaatccgccgcgtaccgggctaacccccgctgcactgtaggagcgagcttgctcgcgaaaaactcatgtacaccgcgttgactctgagtaaacgcgttatcgttgacgttcttcgcgagcaagctcgctcctacacacacacacacactggtttgtttcaaatcgaggctgtcatggcctcgatctgtgtccggcgccatttgcgaccgggccgcaatagcctgataaaggactgacgttcccatgttgaccatcgcactgtccaagggccgcatccttgacgacacgttgccgcttctggctgaagcgggcatcgtgccgaccgagaatccggacaagagccgcaagctgatcatccccacgacccaggacgatgtgcgcctgctgatcgtgcgggctaccgacgtgccgacctacgttgaacatggtgccgccgacctgggtgtggccggtaaggacgtactgatggaatacggcggccagggcctctacgagccattggacctgcgtatcgccctgtgcaagctgatgaccgccggccgtgtcggcgatgtcgagcccaagggccgcctgcgagtggcaaccaagttcgtcaacgtcgccaagcgctactacgccgaacaaggccgccaggtcgatatcatcaagctctacggctcgatggagctggcaccgttgatcggcctggccgacaagatcatcgacgtggtcgacaccggcaacaccctgcgcgccaacggtttggaaccgcaggatttcattgccgacatcagctcccgcctgatcgtcaacaaagcgtcgatgaagatgcaacacgcccgtatccaggcgttgatcgacaccctgcgcaaggcagtggagtctcgacaccgcggttgactcacctgcgtagcccaaaggctgcgcccgtctatccgcctcatagccagaattctcaggtgcccaagcggagcgaacggtagtttagggcgcctgagttttttgccaatcctatgaggccctcgctatgaccacgtccactgcaattgcccgactcaacgctgccgacccggatttcgcccatcatctggatcatctgctgagctgggaaagcgtgtccgacgattcggtcaaccagcgggtgctcgacattatcaaggccgtgcgcgagcgcggtgacgcggcgctggtggacttcacccgtcagttcgacggcctggacgtcaaatccatggctgacctgatcctaccccgcgaacgcctggagctggcgctgacacgcatcaccatcgcgcagcgcgaagccttggaagtggcagcgactcgggtacgcagctaccacgaaaaacagaagcaggactcctggagctacaccgaagccgatggcaccgtgctaggccagaaggtcacgccgctggaccgggctggcctgtatgtaccgggtggcaaggcttcttatccgtcgtcggtgctgatgaatgcgatcccggccaaagtggcgggcgtgaccgaagtggtcatggtggtgccgactccgcgtggtgaaatcaacgagttggtactggctgccgcctgcatcgcaggcgtcgaccgtgtattcaccatcggtggcgcccaagccgtggcggcactggcctatggcaccgaaagcgtgccgaaggtcgacaaggtggtcggccccggcaatatctatgtcgccaccgccaagcgccatgtgtttggccaggtcggtatcgacatgatcgccggcccctcggaaatcctcgtggtgtgtgatggccagaccgacccggactggatcgccatggacctgttctcccaggccgagcacgacgaagacgcccaggcgatcctggtcagccccgacgccgagttcctcgacaaggttgccgccagcattgataagctgctgccgaccatggagcgtgccgagatcatcgagaagtcgatcaatggccgcggtgcgctgattctggtgcgtgacatggagcaggccatcgaggtggccaaccgcatcgcgccggagcaccttgagctgtccgtagcggacccacaggcctggttgccgtcgatccgtcacgccggggcgatcttcatggggcgccacaccagcgaagccctgggcgactactgtgccgggccgaaccacgtgctgccgacctcgggcaccgcgcgcttctcgtcgccactgggggtgtatgacttccagaaacgctcgtcgatcatcttctgctcgccccaaggcgcttccgaactgggcaagaccgcctcggtgctggcccgcggtgaatccttgagtgcccacgcacgcagcgctgaatatcgcatccttgacgagaaggggaactgagacatgagcaaattctggagccctttcgtcaaggacctcgtgccttacgtacccggtgagcaaccgaagctgaccaaactggtcaagctcaacaccaacgaaaacccatacgggccatcgcccaaggcgctggcggcgatgcaggccgagttgaacgacaacctgcgtctgtacccggaccccaacagcgacctgctcaaacaagccgtggccaggtattacggaatcgacgccagcaaggtgttcctcggcaacggttccgatgaagtcctggcgcacatcttccatggtctgttccagcacgatctgccgctgctgttcccggatatcagctacagcttctacccggtgtactgcggcttgtacggcatcaagttcaacgccgtgccgttggatgagcagttccagatccgcgtggcggactacgcgaggcccaacggcgggatcatcatccccaacccgaacgcgccgaccggctgcgtactggcgctggatgcggtggagcagctcctcaaggccagcccggactcggtcgtcgtggtcgatgaagcctatatcgacttcggcggcgagaccgccatcagcctggtagaccgttacccgaacttgctggtgacgcagaccctgtccaaatcgcgctcactggccggtttacgtgtgggcctggccgtgggccacccagacctgatcgaggcgctggagcgggtcaagaacagctttaactcctacccgttggatcgcttggcgattgtcggagcggcggcggcgttcgatgaccgtgagtatttcgcgaagacctgccagttggtgatcgacagtcgcgagaagctcgttgcgcagttgcaggctaaaggctttgaagtgttgccatcagcggccaacttcatcttcgctcgccacccgcaacacgacgcggccggcctggcggccaagttgcgtgagcagggggttatcgtgcggcacttcaagcaggagcggattgcccagttcctgcggatcagtatcggtacgcctgagcagaaccaggcgctgattgatgggctcggcgagctctaagtcacgcaaccaaatgtgggagggggcttgctcccgatagcggagtgtcagtcaacagttgtattgactgagacactgccatcgggagcaagccccctcccacattggttttgtgtcgatggttagatcaacggttcatccggcttcttgttcttccagccatcattgcccggcagcagcaggttcaagccaatcgccaccaccgcacacagggcaatgcccttgaggccgaaatcatccgggccggtgccggtgccgaccagcacaccgccaatcccgaacaccagggtcaccgacacaatcaccaggttgcgcgcttcacccaggtcgatcctgtggcgaatcagcgtgttcatccccactgcggcaatcgagccgaacagcaggcacagaatcccacccattaccggtaccgggatgctctgcagcagtgcgccgaacttgccgataaacgccaggctgatggcaaataccgccgcccaggtcatgattttcgggttgtagttcttggtcagcatcactgcgccggtcacttcggcgtaggtggtgttcggcgggccgccaaacatccccgctgccgtggtggcaatgccgtcacccagcagcgtgcggtgcaggccgggctttttcaggtaatcgcggccggtcacgctgcctactgcaatcacaccgccgatatgctcgatcgccggggccagggccactgggacgataaacaggatcgcctgccagttgaactccggcgcggtgaaatggggcagggcgaaccatggcgcagcagcgatctttgcggtgtcgaccacgccaaagtagaacgacatggcaaaacccaccagcaccccggaaatgatcggcaccaggcggaaaatgcccttgccgaacaccgcgacgatcaaggtggtgagcagcgccggcatcgagatcagcatcgccgtctggtaatggatcaactcggcaccgtcgccggacttgcccatggccatattggcggcaatcggcgccatggccaggccgatggagataatcaccgggccgatcaccactggcggcaacagccggtcgataaacccggtgcccttgaccttcacggccaggcccaggaacgtgtagacgaaaccggccgccatcaccccgcccatggttgccgccaggccgaactggcccttggcgagaatgatcggggtgataaacgcgaaactcgatgccaggaagaccggcacctgccgccctgtcaccacctggaacagcaacgtgcccaggcctgcggtgaacagtgcgacgtttggatcaagacctgtgatcagcggcatcaacaccaacgcgccaaatgctacgaagagcatctgtgcgccagacaggatctggcgccaaagcgggtcgttgaattcatcctgcatgctcacgcgtccttctgcttggtgccgaagatcttgtcaccggcatcgcccaggcccgggatgatgtagccgtgctcgttcaagcgctcatcgatggacgcggtatagatctgcacatccgggtgggctttctcgacggcggcgataccttccggcgcggctaccagcaccatggcgcggatgtccttgcagccggcctttttcagcaggtcgatggtcgcgaccatggagctaccggtggcgagcatcgggtcgatgatcatggccaggcgttcgttgatttccgggacgagtttttccaggtaagtgtgggcctgcaaggtttcttcattgcgggctacgcccacggcgctgaccttggcgcccgggatcaggctgaggacgccttcgagcatgcctataccggcgcgcagaatcggcacgacggtaattttcttaccggcgattttctccacttgtacgggaccggcccaaccggggatctcgtaggtctccaggggtaaatccttggtggcttcgtaagtgagcagcgctccgacttcctgagcaagctcacggaaattcttcgtgctaatgtcggcacggcgcataaggccgagtttgtgtcggatcagcgggtggcggatctcgcgagtgggcatgggaaaggctccggcggcgggcaaaaaaaccggcctagattaatctatccgagggtgttgtcctatagacatcaagtacgttagtccataaaggcttgattggagcgcacgagaagcgtaccttcgcccgcttttcttgccacagcacccccttggagagcgccatgtctgctgatctcgagcatatccgtcaaatcatgcacgaggctgactgcctgtacaccgaagcgcaagtcgaagcagcgatcgccaaggtaggcgaacacatcacccgcgaaatggccgacaccaatccggtggtcttctgcgtgatgaacggtggcctgatcttcgccggcaaattgctcacccatctgcaattcccgttggaagcttcctacctgcacgctacccgctatcgcaatgaaaccagcggcggcgatctgttctggaaggccaagccggaagtctcgtttatcgaccgcgatgtgctgatcatcgatgacattctcgatgaaggccacaccctgggcgcgatcatcgacttctgcaaacacgccggcgcacgtaaagtgcacactgctgtgctgatcgacaaagaccacgaccgcaaggcccgccctgagctgaaagccgacttcgtcgggttgccgtgcatcgaccgctatatcttcggttatggcatggactacaagggctactggcgtaacgccaatggcatttttgccgttaaaggaatgtaaatgatggcccgctttcttgatcagaccctgtttgctgagttggccgagaaagcggccgctaatccccgtggccgtcagaacgtcaactttcatgagatgcaagagccttgtcatcgcatggcagttggcttgcagcccaacacttatgtgcagcctcatcgccacctgaccgctgataaagctgaaaccctgctggtgctcaaaggccgcctgggcatcctgattttcagtgacgcgggcgaggtgttgagcaagcgtgtacttcaggctggaggagagtgccagggtgtcgacctgtcgccaggggtgtttcatggcctggtggtgctggagccggatagcgtgatgtttgaatgcaaggctggcccttaccgtccggttggtgaaggtgaactggcgagctgggcgccccgtgaaggcgaggcgggtatggctgagtatcaccgctggatgcttgcccagttcgattaatccactgagatccaaatgtgggggaaacggtgctttctcgccgcttccgaagcctgcgtcccgcaggtagacttcaagccccgtgtaaatgtctgcaggctggagtcggtaatgcgtaaagataagaaacaggtgattggtgacgagatcggcgacgagcagatcaagttgttcctggacttcgagccggttgatgccacttcgccgtccctgcacaaactgatcaaggcctatcgcggcctgcgtatcgacgacttcgaacggtttctgggctttttcaaggaagcaggctgggacttggatggcaaggacgagcacggccagaccttcgttgacctgatcaaggaccagcgcaacgccgccgaatacatcgaactgatcgacaacgcccgcggttgattatccaggccacaaaaaaacgccccggcctcataagagttcggggcgtttcgcttttaacggtaggagcgagcttgctcgcgaagaacctgagagcgccgcgttaatccacctgcgctgcgttatcgttgacgtttttcgcgagcgagctcgctcctacaggctccaccagctcaaggctgatgttgttctgcgtgttgatcttgcgatacagctcggcatcggtctccaggaccttttcccgtgccgggaagatctcgtgcagcttggtggcccattcaccggctgctttctccgggaagcagcgctcaatcagttcgagcatgatcgacaccgtgaccgaagcgcccggagacgcgcccaacagcgccgccaacgaaccatccttggccgccaccagctcggtgccaaattgcagcacgccgcctttcttcgggtcttttttgatgatctgcacccgctggccggccacttccaggcgccagtcctctgctttcgcctcagggtagaagcggcgcagggattccaggcgctgttccatggattggcgcacttcgctgaccaggtacttggtcaggtccatgttgtcgcgggccacagccagcatcgggccaatgttaccggcacgaatcgacattggcaggtcaaggaacgagccgtgcttgaggaacttggtggtgaagcccgcataaggcccgaacagcagggatttcttgccatctaccacgcgggtgtccaagtgtggcaccgacatgggcggcgagcccaccgcggcctggctatacaccttggcctggtgctgcttgaccacttccgggttgtcgcaacgcagccattggccgctgaccgggaagccgccgaagcccttgctttcctcgatgcccgaggcttgcagcaacggcagcgccgcaccgccggcgccgaggaatacgaacttggcgtcgacatcacggctgttgccgctgttgacgtccttgatgctcacggtccagcccgcaccgttgcgcttgaggccggtgacgcgcttgcagtatttgacctgtgcgtccggcgaactggtcaggtggctgagcaactgattggtcagtgcgccaaagttgacatcagtgccgttcatcacgcgcgtggcggcaattttttcgtcgagcgggcggcccggcatcatcagcggcatccactcggccatttcactgcggtcttcggtgtagtgcatgtccgaaaacgcatggtgctggctgagggtctcaaagcgcttcttgaggaaggacacacctttgtcgccctgcacgaaactcaggtgcggaaccgggctgatgaacgacttggaggagccaaaagtgcccttcttggtcaggtacgcccagaactgcttcgacacctcgaactgggtgttgatgtgcacggctttcttgatgtcgatggagccatcggcggcctgcggcgtgtagttcagctcacacagcccggcgtggccggtaccggcgttgttccacgggttggaactctccgcggcacccgagtccatcagctcaacgacttccagcttgaggccggggtcgagctctttgagcagtacggccagggtggcactcatgatgccggcccctaccagtactacgtcgactgcttcgttatgcgccatttaacgcgtctccaaaatctgcagcaccaaattgacggcatggctgccaggagtgacggggcggttcacgtgttgccccaggttacccatggccaggatcgccatgtccgtttcgcaattctttgcaacttcagcacacgcttcctgccgggctaatctgcctatgaacgcattcatgggcgcctgtggcaattcgacttatggtcaaagcgtgcgattcgtgcaaccaatccgtagcggacaggctcaagctccggtttttgaagaaggctcgatcctgtgtaattgggctgccccagacgctgatggtgcttgtacaaacgccaaactattcatttgctcgccacactcttgtgaagttgtgaaaacccgttttttcacgctcttttgaagacgtgaacctcaaaaaagggctgcccagcctggcacctggcccgcgtacctctgccgacatgcggcaaaacgggcaaacaactcaagtggccgagcgtatggcagctctggcagattcgacaaagacgggtggtttgcaaaggaaacagcaagcacgccagcttcactcgatctgtgtgggcggctctctgtgggcgattttgggggctaatgcctgggcattaacgatgctgcgaggcccgatcaggagacgtccttataatcggggggagattgtagcgaagaacgccaaggaaatgggcgtgttttatgacttttattagcgcctcggtcaggaggccaacacttgccggtgccgtgcgcgaaaaaccggtgggctgacccgggcgctggccggcagtgggcggtgcatccagcccaggtgagtctctgtcacttcgacccaaccttcaccgaccggcggcaggctgcactgcttgaatgcctggcaatggccttgggcatcgagcagggcgaagtggcggtgacgggtgtgtgacatgaacagggtcttgagaaggcgcatggctgtgtacctattgcgttacatgcttgaaggttgccagtgtggcatgacactggggtgacgaatttatgcgaatttgtaatttgcaccctgccttcagccgccgttcaggatcgctggtgagtagcgcgcgtgcaccgttatactggcggcctgtctgcacccagtcctggagaaatgagtatgttgcaacgcctgttgttcggtttgatcactgtgaccagtttgaccctggttggctgcgccaacagcccgcaacaactcagcccgcaacctaaagtcactgcgccattggccgcggtaggccatggccagccggtgtcggtgcgagtggtagacggtcgcccgtcgccgaccctgggttcgcgtggcggtctgtaccctgagactgcgctgatttcggtgaccggccaggacgtgctgcccaagttgcaggcccaggctgaagccgccgtgcgcttgctgggctttaccccgaccaactccccaggcgtgccgcaactgaccgtgaccctggctgagctgaaatatcagtcgcccaaggaaggcctgtatgtgaccgaagcgtccatcggtgcgaccttcaagtccgacgtcagcgccggtacccgtcgctatagcggccgctacgccgcctcgctcaaccagcgcttcgggatgtcgcccaaccaggaaaccaacaccaagttggtcagcgacgtgctcagtgatgccttgacccgcctgttcaaggatccaagcatcggccaattgctcagcgcgcaataaattgtcggcaaaaaaccgggctcatcgctgagcccggtttttttatgcctgcggtttggtcatgccgcagcatcgacataaaagtccagcacactcacgccggtaagcagatccagctccggcaggtcggcatgctggtgcccgccgagggcgcaatacaccagccagtggcggtcctggacgttgaacgcgaggctaccgatcagtgcctcttgctcatcactttgggcgatcagatacagtcggtcctggttttgcgcatgcaacatgacaagctcctcaagcgtggaagggcaacagggtggcttgttaaggtgacgttcaggtgacgctgtaaattactggatacattagccgtcaacggggagggagtatcaaaggcgcaggaggcgactatcgttcagctttgtatctggactgatacccgaacactgatccgccgaggtctgcgatggcgctgcctgcactgttcatcaatgctgttgccctactggttgcctgctcgggcgcccttgtgctgttcatcacccgcctgcacgcgcaacgcgctatggccgacctggccatgcgcagcgaagagcgtgcgattgaccagccgatgctctttttggacacccgcaccgaacgggcgcatcgccaggcttaccgggttgggttcgccggcctggggctggcgctggccctgtcctggtttagcacccacgtgtaagcacaccgcaatacaaatgtgggaggggcggtgcgacgattcgacttgtccccgatagcagtgggtcagatacagataagctgactggcgcaccgctatcgggagcacgccccctcccacattggatgagtgttacagggggattccggccttgacccgatactgattgcgcaccggcgtcgcatattgcaccaccaggtacgggcggtgttcggccgggcattcgttcaggcgtcgttcccattccgccttggccttggccagctcatcggccgggaacacatcggccgccttgggcacttgcagctgcgggtcggcatcactccactgcgcgtacgccaggtaatgcactgggaacagccggtaaccgcctaggatctgtcgatccatttccactgccagcagcttggtatcttcaaagcgctcggtgatcggcggcgcaaaattcacatgcacccggcccttgtagccggtgatacccaaggcaatgctcacatcgtcctcgcctggcgccttgctgtaggtgccggtggtggcgcggatatacagctcgcgggccttggcggcatcgcaggggtcgtactcgtagctgatggacaccggcgtcaggttcaacgactggatgacctcggcaaacggctcgtccttgcggctgacatggaacatcttgaggattgccgattcagtgcggtcatcgccatccttggcccggccttcggcctgggcaatccagatcgactggcagtcgttgcggatcgaatggttgatataggccgacagcaggttataggccgccatcttctcctttcgcccggtaatcgaacggtgcacgataaagctcttgttcaagcgcatcaggtcgctgacaaacggcttttgcagcaggttgtcaccgatggcgatgcgtggcgtcggcaggccggcgtggtacacggcgtagttgacgaaggccgggtccatcacgatgtcgcggtggttggccaaaaacagataggcggtgccggatttgagctgttcgacgccggtataggtcacgccgtcggtcgcccggtcaatggtgtggtcgacgtaatactcgactttgtcctgcagcgtggccacggtggtgacgccggcaaactcgcggcgcaatttgcgcgcgatcatcggcttgagcagccagcccagggcgccggcaaagcgcgggaagcggaagtgggtcaggatgtccagaaaggccttgtcactgaacaggcgcgccagcactgccgggacttcgctgtcgttgtaaggtcggatggtatcgaattcgcccatcatgctctcttgttagaaacggctagggtaagtaaaggaactagcaggagcggcgtgagtaaactgactcagccggaaatagccctgtaaatagaccggcgattatacgcacaagtcaccttggagactgcgatgctggaaactgcgctgtacgattgtccttattgtggcgaaacggtcgagacaacggtggatttgtctggtggtgaccagacctatatagaagactgccaagtgtgttgcaggccgatcacgttcgacctgcaagtccatggtgacgagtggctgcttgaaacccgcagcgaaaatgaatgacaggtacgcgcccatgcagcgaatctacgaaccggaaaacctgatggaaggcgaactgctgcaacagatgcttgccagcgaaggtatcgaagcgcacctggtgggccgccatttgctcggaggtaccggcgaactgccgatcttcggcttgcttgggctggaggtcgacaatgaccaggctgccaacgcccgcgagctgatcaccgcctatatcggtgcgcaacctgtgcccggcgacgaacccgacagcttccccgacgtattggtctgttaggctgtcggtcggtttaccccaagagtcgtgttgccccatgtgtggacgttatgccctgtttcgctggaaccctgcctttgctgccttgcccggcttccccgccgaccagcaggcccagtggaacatctctcccaatgattcggtgctgatccagcgcctgagcgaaggccagctcaccctggcccgtgcgcgttgggggctgacgccgccctggctcaccgacctttcccgcaccccggcccacgcccgtgccgaaacgctcgccgagcaaccgatgttccgcgaagccttccgccagcgccgctgcctgctgccagccaacggtttctacgagtggcgcggcacccagcgcaagcgtccgtattggctgacgccgggggagggctccacactattttttgccgcgatctgggaagcatatccggtgcaggaacaggtgtggctgagtacggcggtgatcacccaggcggcgcagagccagcgacgcccattgatcctggatgcgacagggcaggcggcgtggctcgaccccgagacgccgctgcatgtgttgcagggcttgctggccggtgagcccgccgcgttacgcgagcgcgtgctggccaatatggtcaatgatccgaagctcaatgggccggagtgcctgaccccggcttgaaccggcgccaaccaggtcatctgcactgtgggatgtgtccgaaattcagtagttaaatgtctgatgtatctggcgcggatacaaacgaccgcctacgatacgcgccatgtgttcagggagcgtgttcatgaagaagtcattggtggtaagtggtttggttgcagcaatgctgctggcgggttgtcagtcggttaataccaccagcggcggcgccgttggggtagagcgcaagcagtacatgttcagcatgctgtcgagccaggaagtcgaccagatgtatgcccagtcctaccagcagaccctgggtgaagccagcggcaaaggggttctggacaagaccagcgccaacgccaagcgcgtgcaggccattgccaagcgcctgattgcccaggcacccaccttccgtccggatgcggcgcaatggaactgggaagtgaacctgatcaagagcgacgagatgaacgccaactgcggaccgggcggcaagatcctggtgtacagcgcgttgatcgacaacctcaagctcaccgatgacgagttggcggcggtgatgggccatgaaatcgcccacgccttgcgcgaacacgggcgtgaagccatgtccaaggcgtacggcatcgagatggccaagcagggcgccggggcgatattcggtcttggccaggacagcctggcgttggctgataccgtggccaactatggcatgaccttgcccaacagccgcagcaatgagaacgaagcggacctgattggcctggagctctcggcccgcgccggctacaacccgaacgcggcgatcaccttgtggaacaagatggccaaggcctccgaaggtgccccgccggagttcatgagtactcacccggcttccgacagccgcatcgcttcgttgcaggcggcgattccgaaggtgatgccgctgtaccaacaggccaagaaatcctgatggacgccgtgtaggagcgagcttgctcgcgaaaaactcaccggcaccgcgtttattcaggcagcacgcgttatcgttgacgtttttcgcgagcaagctcgctcctacaggcatcagggccaaccatccctcgtgttcggtttagatccagccactgctttgcatggccttgtacaccgccacaatcgccagtacgaagaacgccgtagccgccaatcggcgaatcaaggtcaacggcagtttctccgctgcaaaattccccgctagaaccaccggtacgttggcaatcaacatgcccagggtggtgccgataattaccagccataactccggatattgcgctgccagcatcaccgtggcgatctgggtcttgtcaccgatttcggcgaggaagaacgctatcaatgtggtcaggaacggcccgaacttgcgggtggtactggcttcgtcatcatcgagcttgtctggcaccagggtccacagcgccgtggcgcagaagctcgcggcaaggatccagtgcagcaccgcgtccgagaagaaactcccgaaccaggcccccacggcaccggccgccgcatggttggccagggtcgcagcgacaatgccggcgatgatcggccagggtttgcgaaagcgtgcggcaaggataagcgcgagcagttgcgtcttgtcgccgatttcggccaaggcaacgattgcggtaggaacgagtagtgaatccagcatcaggtagcttccaggggcgggtcgacacggctatgacacgtacagccttcccgccccgggtaaggtgtgcgtgtcataggtcttgtcaaaccccggtccgtctgtgcggactcctgggtcgcatacgccatggtctgctgaccaagtatgttgacgtatgccggacgagcatggcgctcgtgggagactactcccctaggacgctgcggattctgcctaggcaaaacccattcggcaagccttctttttcaaacgcccgtcagggacgcttggcacggtagatgcgaaaaccattgccctcggccttgatcgcgcagatgcccagatgctcttcgatcaacggctgatacttgaggaaactgttggcaaccaaacgaagttcgccgccttttgccagatgtttggccgcttttcgcagcaggttttccgtggcgaagtaatccgtgtgcacgccgacatggaacggcgggttgctcaagatcgcgttcaaacccatgggcgccgcgtcgatgccgtcaccggtcaacacctcggcttccagcccgtttgcggccagggtcaggcggctgctggcggcggcgaaggcgtccacatccagcatcgtcaccgtgttatgcgggtagcgacgcttgaccgccgcgccgagtacaccggcgccgcatccgaaatcgagcaaatgcccgctgggcagtttatccagatgctccagcaacagctcggtgccacggtccaggcgcccatggctgaacacacccggcaagctcactaccttcaacggaccttcggccagcggtacatcgaagacctgcgccaggctctccagctccacggcttgcggagcattggccacggtgacctgccacagctggcaatgccgcgcgttatccagcttgcgcggcttgccgaagggcagcagctgtttggcagcgctttcgataccgccttttttctcccccaccagaaacagttcggcacccggcaggcgtgcggccacggcgttgagcaggtagtcggtgaggtccttggacttgggcaggaagatcaccgccgcatcaaacgcacgctggggcacattcacgccgaactggctgcgttcggggaagcgcgcgtccagtgccgcctggtcgccggcatgccagcaccagccgtgggcgttgggcaggcgcccgagcaaatcgtcggcaggcaaacctaccagcagcaggttgccttgaaaaagttcggcctggcgaagcagtacttcactgcgcggatccatggtctgctccttgaaaaaggggcgcagtttatcaagtgacgacgcgcagcggggcgccactgaaaaagccccgggcgttttccgtcagttgcccgacgatacgttgccgcgcttcacgactgccccaggcgttgtgaggcgtgacgatcaagcgtggaatgtctccagccagcagcggattgccattgaccggcggttcgacactcagcacgtcggttgccgcgccgcccagatgcccgctgcgcagtgcgtcggccagggcctgttcattgatcaagccaccgcgtgcggtgttgacgacaaacgcaccgggcttgagcagggccaattcacgggcgccgataaagtcactggtgtgttcgttaagtgggcagtgcagggtcagtgcatcgatctgggcgagcagctcatccagcggcatgcgatcggcgcgggcagggcgcccgggtattgcgccgagcagcacgcgcataccgaacgcttcggccaggcgcgccacggcaccgcctaactcgccatggccgagcaggccaagggttttgccttcaagttcgacaatcggatggtccagtaggcagaactgctgggcctgctgccatttgccggcggccacatcctgttgatagtccttcaagcgcgtcgccaggttgagcaacagcatgatcgtgtgctgcgccacagacggcgtgccataaccctggcagttgctcacggtgatgccgtgggcgcgtgcggcttcgagatcgacgttgttagtgccggtggccgataccaggatcagtttgagctccgggcacgccgccagggtttgcgccgtgagcggtattttattgctgatcgcgacttgggcgccctgcaagcgctccaccacattctgcggcgtggtctgctcaaacagctgcaactcgctgaagcagtcacgcaaactgctcaggtcgaggtcgcccagatccagggaggggtggtcgaggaagacggcgcggcgtttgttcatggtcaactgtaccttttgcgacgaggttcgaaggcgtaatctgccgagcctatcagatgaaataatcagttacttaatggagtgagcatgtacgtcgccgagtttttgaccgtagccttgattcacttgctagcggtggccagccccggccctgatttcgccgtggtggtccgtgagagcgtgacccatgggcgccgcgccggaacctggacggccctgggcgtcggcacggcgattttcgtgcatgtaggttattcgttgctgggcattggcttgatcgtgtcccagtccatcgtgttgttcaacgcattgaaatgggcagcggcggcgtacctgctgtatatcggcttcaaggctttgcgcgcccagccggccaagcccgccgccgagggtgagttgcaccgagaagcgggcgagcgcacaccgcgcggcgcgtttaccgcaggctttgtgaccaacggcctgaaccctaaggcgacgttgttcttcctctcgctgttcaccgtggtgatcaacccccacacgcccctggcggtacaggccggttatggcgtgtacctggcggtggcgacggcgttgtggttctgcctggtggcgatgctgttcagccagcagcgtgtacgcgccgggtttgcacggatggggcattggtttgatcggaccatgggcgcggtgctgattgcgattggggtgaagctggcgtttaccagcatgaagtaatcaattttctcaaggggacacagctcaaatgtgggagggggcttgctcccgatagcggtgtgtcagccctacataagctgactgacaccctgctatcgggagcaagccccctcccacattggtcttccataagccgcagatactggcgcaaagccagcatttgctcaggtctgcaaatcattcctttggctgatttggctgaaacataagccctctacagtgcaagtcttcaagccaagaccgtgcagtcattaaagggattcgtatgttgcagacccgagttatcccgcccgccgaaggtgcgtaccaatacccgctgttgatcaaacgcctgctgatgtccgggacgcgctacgagaagacccgcgaaatcatctaccgcgacaagctgagctacacctacccgacgctgatcgaacgcgttgcgcgcctggccaatgtgttgaccgaagcgggggtcaaggccggtgacaccgtggccgtgatggactgggacagccaccgttacctggaatgcatgttcgccatcccgatgatcggcgcggtgatccacaccatcaacgtgcgcctgtcgccggaacagattctctacaccatgaaccacgccgaagatcgcttcgtactggtcaacagtgagtttgcggggctctaccaggccatcgccgggcagttgaccacggtcgacaagacgttgttgattaccgatggtgacaccaagacctgcgagctacccaatctggtgggtgagtacgaaaccctgctggcggctgccagcccccattacgacttcgaggatttcgacgaaaattccgtcgccactaccttctacaccaccggcactaccggtaacccaaagggtgtgtacttcacccatcgccaactggtactgcacaccatcggcgtggcgacgatcatgggcagtgtcgacagcgtgcgcctgttgggcaccaacgacgtgtacatgccgatcacgccgatgttccacgtacacgcgtggggcctaccctatgtggcgaccatgctcggcttgaagcaggtctaccccgggcgctacgaccctgaatacctggtggagctatggcgcaaggaaaaggtcaccttctcccattgcgtgccgaccatcctgcaaatggtgctcaacgccaaggccggccagggtgtggattttggcggttggaaaatcgttatcggtggtagtgcgcttaaccgctcgttgtacgaagcggccaaggcccgaggcattcaactgaccgctgcgtacggcatgtccgagaccgggcctctggtgtcctgcgcccacctcaatgccgaactgatggccggcagcgaagacgagcgcactacctatcgaatcaaggccggcgtgcctgggccgttggtggaggcagcgatcatggatacgaacggcaacttcctgcccgccgatggtgaaacccagggcgaactggtactgcgtgcgccctggctcaccgagggctattacaacgagccgcaaaagggtgccgagctatgggccggcggctggatgcacaccggcgacgtcgccacgctggatgcgttcggcgtgatcgatatccgcgaccgcatcaaggatgtgatcaagaccggtggcgaatggatctcgtccctggctctcgaagacctggtcagccgccacccggcggtacgcgaagtcgcagtggtgggcatcgccgacccgcaatggggcgaacgcccattcgccttgctggtggtgcatgagggccatgttatcggtgcacgagagctcaaggagcacctcaagcctttcgttgaactggggcatttgagcaagtgggcgatcccgagccagattgccgttgttactgaaattcccaagaccagcgtaggaaagctcgacaaaaaacgtatccgcatcgacatcatcgaatggcaggccaacaacagcacgttcctgtcgacactctagtgcccctcgccgcgcccgttcaggcgcggcaacgctctatcttgcggctttacttgtgatttaccgaatttcagccatccttctcgcgccggccttcgtcggcgtggcgaaagggttgtggcagacggcttggtgatgcaaatcacactttagagggatcaagcgatacctaccgctggctatagtccctttcagagtttttcaaggatgttgtgcttcgggccatgggggcccggttgtcgtgcggcattggaatcgttgtattccggccgttacatgcatccagccgcagaactcactgccataacaataaaatgcacatggagtagcgtcgatgacctcagtaaaccagttctggcgccgggcaagactgcccctggccgtcagtctcgcttctacgctcgccgggcccgcattcggcgtcagtttcaacattggtgaaatcgaagggagttttgattcgtcgctttccgtcggggcaagctggtccacggccaagcccaaccgcgacctgatcggtgccaacaacggtggcaagggcttgtcccagacttccgatgacggccacttgaacttcaagcgcggcgagacgttctcgaagatattcaagggcatccacgacctggaactgaagtacggcgacaccggtgtgtttgtgcgtggcaagtactggtacgacttcgaactcaaggacgaaagccgtcagttcaaggacatcagtgacaacaaccgcaaggaaggcgccaagtcttcgggcgggcagatcctcgatgcgttcgtctaccacaactactcgattgccgatgcgccgggctcggtgcggtttggcaagcaggtggtgagctggggtgaaagtaccttcatcggcggcggcatcaactctatcaacccgatcgatgtgtcggcgttccgtcgtcccggcgccgagatcaaggaaggcttgatcccggtcaacatgttctatgtgtcccagacgcttaccgacaacctgtcggcagaggcgttttaccaactggagtgggaccagaccgttaccgataactgcggcaccttcttctcgcagccggacgtgatctccgatggttgcagcaataacctgcgggtactgaacaagcgctcgaccatcccggccgcagccttgccgaccctgggtgccctgggtgtggacgtcaacagcgagggcgtgctggtgcgccgtgggccggaccgtgacgcacgggacagcggccagttcggcgtggccatgcactacaacttcgagccgctggacaccgagttcggcgcctacttcatgaactaccacagccgtgcgccgatcttcagtgcacagggtgcgccatcggcggcctatactcgtcctttgggcccgctgggggcattgcgtccgctgatcgtggccggcagttcgaactacttcgtcgagtatcctgaagatatccgcctctatggcttgagcttctctaccacgctgcctacaggcaccgcctggagcggtgagttgagctaccgccccaacgcaccggtgcagttgagcaccaccgacatcctgttcgccggtgtcacgccgattccgggctttggtaatgcttccgtgctcaagggttcgcccggccaggatctgcatggctacaaccgcaaggaagtcactcagttccagaccaccttcacgcacttcttcgatcaggtcatgggcgccagccgcctgaccacggtcggtgaaatcggcgtgacccatgtcggtggcctggaaagcaaatcccaggcgcgttatggccgcgatccagtgttcggcccaggcaccttgccgggtggcttctgcgccgcgcttaacaactccaccgccaacggcgccggcctgcccaacgctgccggcttgaacaccaactgcaacaacgacggctacaccaccgcaacctcctggggctaccgcgcccgtgccatctgggaatacccggacgtgttcgctggcgtcaacctcaagcccaacgtggcctggtcccatgacgtcaagggttactcgccaggccccggcggcaacttcgaagaaggtcgcaaagccgtcagcctgggcctggatgccgagtaccagaacacctacaccgcgagcctggcctacaccaacttctttggtggcaagttcagcactgtggatgaccgcgacttcgtcgccttgagtttcggcgccaacttctaagcacactcttttcaagtggcatgtattttcaggaagaccagagtatgaaaataactaaaagtctgttgcacgtgggtgtgcttgggctgtcgatcctggcgagcaacgtcatggcggcagtctcggcggatgaagccgccaagctcggcacgaccctgaccccgatgggcgccgagatggcgggcaacgcggctggcaccattcctaaatggtcaccactgcccaccaatgccggcgccgtggatgccaaagggttcctggccaacccatacgccagtgaacaaccgcagttcaccatcaccgcgcagaacgtcgagcagtacaaggacaagctggcccccgggcagtacgcgatgttcaagcgttacccggacagcttcaagatgccggtttacccgacccaccgcggtgccaccgtgccggctgaggtgtttgcctcgatcaagaagaacgctaccaccaccaacctggtgtccggcggcaacggcctggaaaacttcgagaccgccgtacccttcccgattcctaaaagcggcgtcgaagtcatctggaaccacatcacccgttatcgcggcggcagcgtgacgcgcctggtcacccaggctactccgcaaaccaacgggtcctacagcctggtgtacttccgcgaccagttcgtgttccgcgacaaaatgaaggacttcgacccgaaaaacccgggcaacgtgttgttctacttcaagcagcaagtcaccgcaccggcccgcctggccggtggtgtactgctggtgcacgaaaccctggaccaagtgaaggagccgcgttcggcgtgggtctacaacgccggccagcgccgcgtgcgccgggcgccacaagtgtcctatgacgggccgggtactgccgccgatggcctacgtacgtccgacaacctcgacatgtacaacggtgcgccggatcgctacgactggaagctggaaggcaagaaagaaatctacatcgcctccaacagctacaagatcgacgaccccaagctcaagtacgccgacatcatcaaggccggccacatcaaccaggacctgacgcgctatgagctacgtcgtgtctggcacgtggtcgccaccttgaaggaaggccagcgccacatctacgccaagcgtgacttcttcatcgacgaagacacctggcaagcggcggtgatcgaccactacgacggccgcggccaactgtggcgcgtcgccgaagcccatgccgagaactactacgacaagcaagtgccgtggtacgccctggaaaccctctacgacctgcagtccggccgttacctggccttgggcatgaagaacgaagagaaacaggcctatgacttcggcttcaccgccaccaccagcgacttcaccccagcggccctgcgccaggacggtgttcgctaacctgtaggagcgagcttgctcgcgaaggtcgtcaacgataacgcgcccatcctggatgggcgcgttgtttttgagtgcttcgcgagcaagctcgctcctacttcttcccaggagtctgggcgagatattttttgtcgcagttctttttcagccatttgttgcaaagatctacaatcccgccgcttttaccgctagtctgcggacatctgcaatgccgacaacagccttctacaagagcccggcgatgactgatctgtcccgaatccacgggcctgccagcgtggtgattccgaccctggaaggccgtttctacagacccccgctacctgacggctacgtgctgcgcccgcgcctgtgcgaacggctgaatgccggcctggacgggcgactgctgctggtctgtgcccctgcggggttcggcaagagttcgttggcggtggagttctgccagggcttgccagcccattggcaaagcctgtggttgggcctgagcccaagggacagtgaccccgggcgcttcctggaacggctgctggatggcttgcagcagtactttccacagctcggcggccaatccctcgggttgctgaaaatgcgccagcgccatcaaccctttgcctttgaagaatggctcgatggcctgctcgatgagctggcgatgcacctgtctacgcgctcgcctttgttgctggtgctggacgactaccacctggcccagggcccggtgctggatcgctgcctgcagtttttcctcaaccatttgcccgatgggctgttggttctggttaccagtcggcagcgccccgattggcacctggcgcgcctgcgcctgtcgcggcacctgctggaactgcatgagcaagacctgcgcctgacccatgacgaatccctggctgtgctggatgggcacagcagcgcgttgcgcggcgaggcgttggaaaacttgatccgccgtagcgagggttgggtcgccggcctgcgcttctggctgctggcggcctccgaagctggcagtgacggcgccttgccccagagccttcacggtggcgaagggctgattcgcgattatttactcgaagaagtcatcgattgcctgcccgtggaggtgcaagggttcctctacgacacggcctcccaggagcgcttttgcagcgagttgtgcgacgcagtgcgcgaagcccatgacagcgcagaaatcctgcgttatctgcaggctcaccaggtatttctggtacctctggatgagcaaggccattggtaccgttatcaccatctgttttcggacttgctgcgtacccgccgcgagaagagcgcgaccttgccgccggccagcttgcacttgcgcgcctgccgttggttcaacgcccaggggttgatcgacgaagcggtggagcaggcgctgcgggccggtcatctggatgtggcggcgaacctggtgcagaacctgtccgaagagcagctgttggcggagcagaatgtcggcatgctgctgcgctggaagatggacttgcccgacagcctgctgatcagcacaccgcgcttgatcgtgctgtatagctgggcactggggctggcgtgccaattggatgcggcgcaggagctgtccagctatctcagccgcttcctgccggcgccatcggccaccgcgcagaaatccatgctggcccaatggctggcactgagcgggatcattgcccgtgggcgcggggaccgcgagctgacccagcgctattgcaacgaggcgttggaaagcctgccgcaaaagcgttacggccagcgcctgatgtgcctgtcgaccctgtccaacctggccatagtcgatgctgacctgtggcgcgcccggggcctgaaccgcgaatccctggaactggcgcagcgcgtcggtaacccactgtttgaagctttggctcattacgaccgggcccgggtgctgcaggcgcggggcgagatcctgcggtccctggacgaagtacgccagggcctggagcgcctgcacggcctggcgccccaacggctgtacgccgtgcgcgcgcggttgtcactctatgaaggctacctgctgctggcgcgttaccaacccgaagccggccttgtgcgcttgcgcgccggcttggccgaagcccgcgcttgccgggacatcagcgtgctgatcgggcattgcgtgatcgccaacttcgaaggccggcgcggcgatttttccaatgcctttgccgagctggccgaagccgagcgcttgatgcatatctgggacgtgccgccgatctactatctggcgatgatcaccctgatcaaatgcgaattgtggctggcccaggggcgcactgacttggccgatgcctggctgacccggctcgggcagacctacaacggtgagcacgccgcggccgctccggagtttcatccgcacctgccacagcatatcgagctgcaacaagctgccctggatgccgcgcgccatcagcccgacattgccctgcaacgcctcgaaagactggcgcaacaggcccatgacagtgggcgccagatgattgccctgatggccctgacccagcaggcacagctcctgctggagtgtggtcaggaggccaaggccaggacggtattggctcgcgcacttgaagctggtgcgggcggcgcgctacagccgtttcagcggttgctggaaggttacccggactggatgcgcgagcagctgggcaaggaagcccatggcctgctgaaccagagcttgctggcgctgctgcctcaagcccgtgtggtcgaggcctcgcctcatcaagaaaccctgagcacgcgggaactggcggtgctgcaactgattgcccaaggctgttcaaaccaggaaatcagcaaccagctgtttatctccctgcacacggtgaagacccacgccagccatatcaacagcaagctcggcgtggagcgtcgaacccaggcggtggcgcgagccaagtccatgggtttgctggcctgagtgcatcgccgtttattgtgcagcagggcagcctttgagtgatgtgtcgaccgtctgattgatcaacgccgcgaaacgcttgaggttgttctggtgcgccaacaccagctcgtcgatgctcggccctgcaggtgactgcaaggtgctgcgacaagtcagggccgggtgatcgccgttgacctgccgcaggcgccagcgcacgtcgagcaacgcgtactgcccggggaccgagtcaaaacgctgtacttcaacgcgcaaggccacagcctgctgcggattgctgttggccaactgatccaccaaagcgctcctcagctcgtcggcgaggctggcagcccaccactgggtttcaagaatcgccaacccactgtcgccctggcgtaccactatctgcgcgcgatcaacctggggcggcacactgatgctgtcaatgcgcacgccggcggcatccgctcgcgagctgttgctccagtgcgccggggtcagggtgtggaaggcaatgggttcactgcgacacgctgcgagcagcagcagggaggtcagcagcgtgatcttcaacggcagcgtcatggcggctccaatggtcatttgcgcggtggtccttgcaggtcggtcggcgcggcgttatcgggacgaccgcgaatcagcgactccggatgccggccaaggtaatccgagagttcgcgcaaggagcgcgacatgcgcgccagttcatccagggtctgggtcagttgttcacgctgcggcgagtcttcggccagagtagaactggctgattggagggtcttgctcacgtcggccaacgtcgtctgaacacccggcagagtcttggcgttgaattgcgccagccccttgcgcagttcgaccaggctggcgtcgaggttgccggcaatgcgctcgacaggcagttggctaagcttgttgacgatgccttcgagcttctcctgcaactgttcgaggttgccggggatcgtgggaatgccaaccggacgttggttggggtcaaatgcgactttctcggctttggggtagaagtccagggcgatgtacaactggccggtcagcaagttaccgctgcgagcctgggcgcgcaggccgttttcgatgaagctgccgatcaggcgcacgccagccgcctcatcgtcagggttattgttcatggccttgagcagcttggtatgggcttcgccgagcagttgcggatagatcacgatgccgacattcaccgggaagctgcgtttcttcgcatcgaaatccaggttgatcgacaccactttaccgaactcgacgccgaggaactccaccggcgcgccgactttcagcccgcgcagggcctggtcaaagcgcaggaccatgtattgccccttgccattgggcggggcgagggcgctttgctggtcttcgaacagttcaaaaccgcggttttcctcggctggcttgtcgttggggttgtagggtggggcctggaaggagatcccgcccatcaacatggacgacacggattcggtcttcaacgcaaagccattggcgccgacgctcaaatcgataccgctggcattccagaagcgggtgttctcggtgacatacaggtcattgggcgcatgcacgaaaatttcgatattcacgcccttgccttcgctgtccagctcataggccaccacctggcccacggggattttgcggtaatagaccggggagccgatatccagcgaccccaggccctgggtatgaagggtgaagcgcttgcctggctcgccgtaggtgatgggcggcggattttccaggcctgtgaactgtttggcgcgggtctcggattggccgatgtctgcgccgatgtagtcaccggaaagcagggtgtcgatgccggatacgccgcctgcgccgatacgtgggcgcaccacccagtacttggaatcttcgcgggtgaaactttccgcctgcttggacaactcgacggtggcgttgacgcttttctggtcatcgctcaatgcgacgtctgtgacttggccaatcaccacgttgcggtatttgacttcggtcttgttggcgaccagaccactgccggtcttgaagttgagggtgatggtcgggccttgttgcatgacgctgtgaatcaccagcgagatgcccaccaacacagcgacaatcggtacgatccacaccagtgaaacgctgaagcgacgcgtcttgatcgcaggcttgcctgctggggtgtcaacgtcgtgtggcgtcatccgaacgctcctcatagtgtgggttttcccagataagccgtgggtcgaaactcatggccgcgagcatggtaaacaccaccaccaagccaaaaaacagaatgcccaggcgcggctcgatcgtgcccagggcctggaacttcaccagtgcggccaccagtgcgaccacgatcacatcgagcatcgaccaatagccgatcagctcgataaaccggaacagcttggagcgctccttgcgcgcccacaggctattgcgctgcacggtgaccagcaacagtgccaatgacacgaacttgatgcccggaacggcgatgctggcgatgaaaatgatcagggcaatgtcccaggcgccatgctgccagaactccagcacgccgctcatgatggtactgtctgcccccgagccgagcatggtggtgttcatcaccggcagtaaattggccggtacataaaaggcgagggcggtgagcatgtaggcccaggttcgggtcagggactgaaccttgcgccggtgcaagggcgcgccgcagcggtcgcactcggtgggctcttggagcatgtcgcaggcctggccgcaggtgtggcacaggcacaggttgagctcgcgggcagtgggcggtgaattcatacggtgtcccacaggtcgcgcacatcgcgcccggcaatgcggatcagcaacaggctgagggcggccaaggcaaacaggccggtgccggggattacatccagcataccggccagcttgaacaccgcgaccatcgcacccagcaggcagacttccagcatgctccagggcctgagggcttccagccagcgcatgcacagcttgaatgccggcgagcgtcggccggccaaggcgaagctcaatacccagatcagcaacagcagttgaaacaccggcgcgatgatgatggaaattgccgccaccaacgcaataaacgtgatcggccccaggctcaacgccaccaccgaatcccagagcgtcgcgctgtttttcaagccctgcaggctgatgctcatcaccgggtaaaagttggcgaaggtccacaacaccgctgcggttaccgtcagggccaggcgttgttgcaccgtcaggccgttatggcgctgcaatacgcccgcgcagcgtacgcacagggcggtttgatgtttggcgagcgtgactttttcgtacacgcagtcgcagtgttcgcagatgacctgctgttgattcgccatacgtcttgctccaaacgcgacacgctgcggtcctggctgttgctgggttcgatggcgcttgagtagcttagcatttgatgcaacgcaaattcgatgccttccagatctggggcaacgtcaaccatactgtgtcaggaatgccatagagcttgcaggaacgtcccatgcttaaccagaaaggcccgttgatccgcgaaactttccccgtcggcccgttgcaatgcaactgcaccatcatcggtgacccgatcagcaaaaaagccattgtggtcgacccgggcggcaaccctgagttgatcctggcgcggctggctgccctgggcctccaggtggtgagcattatccacacccatgcccatctggatcacttcctggcctccgggcagttgaaggagaagaccggcgcgacgctgcacctgcataaagaagatcaattcctctgggacaacctggaaatgcagtgccggatgtttcgcgtgccctatgtcccggtgccgtcgccggaccgctggctggaggatgacgaggaactggcctgcggttgtggcgtggccttgcacacaccagggcatacgccgggttcgatgagtttctggtttgccgatgccaagttgctgattgctggtgacaccttgttccggcgcggcgttggacgcaccgatttatggggcggcgaccaggcgacaatcgtgcgttcgatcaagcagcgcctgtatacgctcgacgaaggcgcgacggtggtcaccggtcatgggccggacacctgcctgggcgacgagatgcgggaaaatcccttcgtgcgcgcttgatcgtcgatgagtctgacaagcgctgcagcaaaacccaggtcgttttctgcctgcgtctgctacggttcctgtagcggtgacattggctaaccttttgttacagcatgggcggcggccacggaatttttaccgctggtcgtgttccaaactcggcacaggtccattgccaatgtcctctgcatcacagaatgcaaaagtaggagcttcccttcatgtttactccgcgtcgtctgcttgttgtcgctaccgccgtagccctgttgtctggctgcgcttcacctaatccatatgacggcagccagggacaggccagcaatggttccgaaagcggtatgagcaagaccgccaagtacggcggcctgggtgcgctggccggcgcgttggctggtgcggccatcgaccataacaaccgtggcaagggcgcgctgattggcgcagtcgtcgcgggtgccggcgccgctggttatggctactacgccgaccagcaagagaaaaaactgcgcgaaagcatggccaacaccggggtggaagtgcagcgccagggcgaccagatcaagctgatcatgccgggcaacattaccttcgccaccaactcggacgcgatctccagcagcttctaccagccgctgaacaacctggccaactccctcaagcagttcaaccagaacaccatccagatcgtcggctacaccgatagcactggcagccgccagttgaacatggacctgtcccagcgtcgtgcccagagcgtggccaactacctgacttcccagggtgtcagcgctgccaacctgagcgcccgcggtgccggcccggataacccgattgccagcaactccgacgtgaatggccgtgcccagaaccgtcgcgtagaggtcaacctcggcccgatcccaggccagcaatacggccagccgggccagcaacagcaggtgccacagcagaacaatcagttccagggcaatccataccagcagtaccaataaaccctgctcactaaaaagggcgccgtgcagtcaatgcacggcgcccttttttgtggctgccgatctacatcaatcgatgtactcgaacaccttgacgatcttctgcacaccggacacaccctgtaccaggttggcggcacgggtggcttcggcctgggtcagcaggcccatcatgtagacgatgccgttatcggtgacgatcttgatccgcgaacccgggaccgcactgtcggtaagcatctgcgccttgatcttggtggtcagcaaggcatcgttgctgatggccagcagggtgatcgggtccatgacctgcaactcgttatggaccttcttgacccgctgcacccccgcggcggcttgctcggcctgggccttgaggtcggcgcggggtgtttgccctgccagcaggacgacaccgttgaagctggtcactacgatgcgcgatgcaccgttgcccaggtcggtggcggccttggcgacgttgaccttgaccttggtttcgatcagcgaatcatcgatggtgctgccgaatgtgcgcgtgcccctgtcgtcctggatgggggtgtcccgtgtggcggtgattgccgagctgcagccgctgatggctaggcacagcgtaatggccataaggctgaggcggttaacggtcattcttcactcccgaacagttggctgtcgatcagatcgcacaggcagtggatcgccagcaggtggacttcctggatgcgtgcggtgacattggccgggacgcgaatctctacgtcctcgggcagcagcagcgaagccatgccgccgccgtcgcgtccggtcaaggctacgacaatcatttcacgatcatgtgctgcctggatcgcctgaataatattcgccgagttgccgctggtggaaatcgccagcaacacatcgcccggctggccgagggcgcggatctgcttggaaaagatttcgttgtagctgtagtcattggcgatcgaggtgatcgtcgacgaatcggtggtcaaggcaatggccggcaggctcgggcgctcacgctcaaagcgattgagcagctcggacgaaaaatgctgggcatcgccagccgaaccaccgttgccgcacgaaagcattttgccttcgttgagcaaggcgttgaccatgacctgactggcttgctcgatgtgcggtgcaagtacgtccatcgcctgttgcttggtgtcgatgctggcctggaaaagctggcgaattcgggattgcatgtccatctgtgtgaccttaagtagcgcggctgtttggcacaggtaatgtgcagcccgcaaagcaaagagcaaaagtgtgggttgaaggtgccgggtgggtcagctgtcgaaggcatccttgagccagttcaaatcagcgggacccgacggtgtgctttccatggctaccacatcgaaacggcaggggctgtcagcccagcgatgctctttttgcaggaagaactgcgcagcgagtatcagcttctgacgtttgcgcccgtcgatactggcgagcgcgccaccccattgtgcgtgttttctatagcggacttcgacaaatactactgtatcgccgtcaagcatgaccagatcaagctctccgcgtttacacaaccagttctgcgccaaaaggcgcagaccctgttgttgcaggtatttcagtgcctggagttcggcatccttgccgctttgtgcgctggaccgctcgggcatcagcgcggggtatctggaaggcgctggatgtcgccgccgacgaatttcgcccatggcatctggcgatcaacgcgctggttggcgctgatgcccaggttgcccgagaggccgtcgacacgggtgtccggcagcgccttgagctggcccaggcgaggcgccaggcggtaggcatcgacacccatggcgtacaggcggccgaggctgccattggcctgtggccattgtgcggctacctggttgcgcagcgggtcggtggtattaagcagccaaggggtttcgcagaacatcacgttggtcatgtccaggtactggttgcggtcgccgctggcactgaatacgtgggatgtcgcgtagaccggcacatcaccggcgtactggaagttcagggtcggcttgatctgctgggccagttgcggggtgacggccaggaagatgaactcgatgtcctggcgacgcgaaggctgggcggcaacgtcggtgccgaccgtgctttgcaggctcttggcacggccttcacttttgcgcagctgaaacagatcggcgatctgttgggccagtgccacgggctgatcgacatattcgacacccatgacggtgccgccattggcttcccaatcctggcggaaggccttgtagacacgctcgccccattcgccacggggcaccatggcggcggcgcgatgcaggccatcggcgcgggcacggcgcgacacttcacgggcttcgtcttcagcggccaggccgaactggaacagttgtgccgggccttgatcggtctcgctgtagttcagcgccagggtagtgatcggcaattgcgggcgtgcactgagctgcttgaccagtggtttttccagcgggccaaccaccaattgcacgccggcggcctgggccttggcgtagaagtcgtcgagggaggtcatgcgcgagctgtcgtagaactcaatgatcggcgccttctgcccggcttgttcggcctggtagtgagccgccatgaagccttcacgcagcgccttgccaaccgaagccagcgggccttcctgcggcagcagcacggcaatcttgttcaatggctggctggccagttccttgagcttggtcagcggcgtaggcagttgaaccgcggccgggtggcccgggttctgtgtgcgccaggtatcgatggcggcttgttgttgctccagggtgccggcacccttgaccgcctgggccagggtaatccagccgtccagtgtcgggttgccggtggcttgcagctgttcggcaggcaacgcagcaatcaatacccagatggcttcgtggttgcttgcagcggcatccccggtgagcagcggtgccatggctacccgctcgcgagcggcggcgagggtctggccatcggcttcataggcgcgggcatgcacggtgccggtgcggatctgctggtctgtcggcagctccttcaggctttgcaggctgggatggttcagcgccgccaatgccgccttaggctgattgcgcgtcattgccagttcggcggccagggtgctggcaaatacttgagcggccggcttcaggacatccaggggcacctgcgcaagaatctgcgacgagcgtgcagggttgttctgctggtaggccaggtcagccgcactcaggcgcaacatggcggccttttctggcgtcttggcgttcgttgcctgttcgagcaattgctcgatactggcatccggggtccgtggaaggtcgccaaggctggacgagggcgagctggcgcaagcggccagcaaggcagcgaggcagagggcggagagcagccgcaggcaagcgatcatgtaagtgttcctgataccgatcaaattagcgtggaagtgtacccaagcactggcccaggcgcgatgttagtggcgtgaaacagtcgatttaggtcgtgcaaatgttgcgtttaactaacggtggctgaatcggcatccaccgtgatggcatattttcaaggcgtctacgcgctacaatgttgcttttgccaaccatcgaggtgtgcgttttgactgctccaggtccattgaattccactgcaggctcgctttttgtcgtggcgacgcccattggcaacctggacgacatcagtgcgcgggcgctgaaagtgttgcgcgaggttaaattgatcgcggccgaagatacgcggcactccctgcggttgatgcagcattttggaatcagcacgccattagcggcatgccacgagcacaacgagcgtgaagaaggcagccgtttcatcacgcgcctgctggccggcgatgacgtggcgttgatctccgatgcgggtacgcccttgatttccgatccgggttatcacttggttcgccaggcacgcgccgctggtatcaatgtagtgcctgttccgggagcctgcgcgctgatcgctgcattatctgccgctggcctgccatcggaccgctttatctttgaaggcttcttgccggccaaggcggtggggcgtcgcgcacgcctgcaagcgttgaaggaagagccgcgcaccctgatcttctacgaagccccgcaccgtatcctggagtgcctgcaggatatggagctggtgtttggcggtgagcgcctggcgctgttggcccgggagctgaccaagacctttgaaaccctcaagggcttgccgctggaagagcttcgcgcatttgtcgaaggcgacagcaatcagcagcggggtgagtgcgtggtgctggtggcgggttgggttgcgccggaaaatgaagatgcggtggggagcgaggcgatgcgcatcctcgatttgctgctcaaggaaatgccgctcaagcgtgccgcggccttggcggcggaaattaccggggtgcgcaaaaatgtgttgtaccaggtggcgctggataagcagaaagccgaatagttccgggggggaacctgtattgcgtctgaacgtgatggcaccgcggtacttttaatacttgtcctgaggccgccgtgccgttaacctgcgcggcggagagtcgattggacagtcgctgccctctatgaaaattaggggggggaggaaagtccgggctccatagggcgaagtgccaggtaatgcctgggaggcgtgagcctacggaaagtgccacagaaaataaccgcctaagcacttcggtgccggtaagggtgaaaaggtgcggtaagagcgcaccgcacgactggcaacagttcgtggctaggtaaaccccacttggagcaagaccaaatagggtcccaaggcgtggcccgcgctgggaccgggtaggttgctaaagatgtccagtgatggccatcgtagacgaatgactgttcaagacagaacccggcttacagatcgactctccaccttttttccttgcgctcgaatctcgtgcgcaaacccggtagtaacgcaagaatccctccctgccaaatcattggcagatgcatcttcgtaataccaaaaaaatcttactcttaataaattactttaactttaggtcgtagctctctgagctatttgccgttgttgagtcaaaaacatcgtcaaactctggtttctcctccttttaccttcctaaatctccgttctgtaaggcttttccttgaatacgcgccttgacggtgtggtaggcgcattcctatagtgtgcgcaagtggcggaaagtggcacaaagtgggttttttgaacgtaaaacgctaaaatttggagaaacgcatctgtgtttcgcggagctaacgctatcagtctcgatgcaaaaggccgtctcgccatgccgagccggtatcgtgacgagctcatttcgcgaagttcaggccagttgatcatcacgattgacgccgttgacccttgtttgtgtgtttaccccctcgatgagtgggagttgattgaaaccaagttgcgcgcgctgccttcattgcgtgaagaaaaccgccgcctccagcgtttgctgatcggtaatgccgtcgaccttgaactcgatggcagcggtcgtttcctggtgccaccgcgtctgcgcgagtacgccaagctcgacaagcgcgcaatgctggtgggccaactgaacaagttccaattgtgggacgaagatgcctgggatgctgtgtctgcagcagacctggctgctattcaacaaccgggcgccatgcctgatgaactgcgtgatttgatcctgtgactattgatagcggctttaaccacatcaccgtactgcttgacgaagccgttgaggctctcgccgtacgcgcggatggctgctatttggacggcacctttggcaggggcgggcacagccggttgatactcagccagctcggacccgacggtaggctcctcgggttcgacaaagaccctcaagcgattgccaccgggcaagcgctagcggccgaagacggccgctttgtcgttgtgcaacgcagctttgccgagttgggtgccgaagtcgccgagcgcggcatggcgggcaaggtggccggggttttgctcgacctgggcgtgtcttcgccccagctcgacgacccggagcgcggcttcagcttcatgaacgacggccccctcgacatgcgcatggaccctacgcgaggcgtcagcgctgcgcagttcatcgccacggctccggtagaagaaatcgcccgcgtattcaaggaatacggtgaagagcgctttgccggccgcatggcgcgcgccgtggtcgagcgccgtgaaatccagccgttcgagcgtaccgccgacctggccgaagtgctgaaggtcgccaaccctgcgtgggaaaaaggcaagaaccctgcgactcgtgcgttccagggcctgcgcattcacgtcaacaacgaattgggcgacctggaaaccggccttgaagctgcgcttgacgccttggaagtgggcggtcgtctggtggtgatcagcttccactccctggaagaccgcatcgtcaaactgttcatgcgccgtctggtcaagggcgagtccgacaacctgccgcgcaacctgccggtacgtttcgaagcctttgtgccgaaaatcaaaatccatggcaaagcgcagttcgcttccgaagccgagctcaaggccaacccacgttcccgtagcgccgtcatgcgcgtcgcggagaagctgcggtgagcaagcttttcgccaagcccctcccgggcggcagcttctttatgttgctgctgtttgtcggcgtgctggtgtccgcgattgcggtgtcctacagcgcccattggaaccgccagttgctcaacaccctgtatggggaattgagcgtgcgtgacaaggcgcaggccgagtggggccgcttgatcctcgagcaaagcacctggacggcccacagtcgtatcgaagtgctggccaccgaacagttgaagatgcacatccctggcgcggccgaagtccgcatggtggcgccatgatgaaactcgaaggcgcactctacccatggcgtttccgcctgatgcttggcttgctggcattgatggtgggcgcgatcgtttggcgcatcttcgacctgcaggtggtcgatcgtgacttcctgatcggccagggtgatgcccgaagcctgcgacatattccgattcccgcgcaccgtggcctgatcaccgaccgtaacggcgagcccctggccgtcagtaccccggtaaccacgctgtgggccaatgccaaggagttgcaggtcgccaaggacaagtggcccgaacttgccgctgccctgggccaggaccgcaaagccctgaccgaacgcctggaagcccaggccaataaggaattcatctacctggttcgtggcctcacccccgaacaaggccagcaagtgctcgaccttaaagtccctggtgtctatggcatcgaggagtttcgtcgtttctaccccgcgggtgaaaccacggcgcatatggtcggttttaccgatattgatgaccatggccgcgaaggcgtagagctggcctatgacgaatggctggccggtgtgcccggcaagcgccaggtcatcaaggatcggcgtggcagattgatcaaggatgtccaggtcaccaagaacgccaaggccggcaagcccttggcgttgtcgattgacctgcgtctgcaatacctggccaaccgtgaactgcgtaacgcgatcatggagaacggcgccaaggccggcagcctggtgatcatggatgtgaagaccggcgagatccttgccatggtcaaccagccgacctacaacccgaacaaccgtcgcaacctgcagccggcgatgatgcgtaaccgcgcaatgatcgacgtgttcgaaccgggttcgaccatgaaagccatctccatgagcgccgccctggaaaccgggcgctggaaacccagtgacaaggtagaggtgtatccaggcacgctgcaattaggcaagtacaccattcgtgacgtgtcccgcagcgaaggcccgatcctggatttgaccggtatcctgatcaactccagtaacgtcggcatgagcaaggtcgcctttgatatcggcggcgaggccatctatcgcctggcgcaaaaaatcggcctggggcaacctaccggtctcaacttcccgggtgagcgcgtcggcaacctgccgaactatcgcgaatggagaaaggctgagacggccacgctttcctacggctacggcttgtcggtgaccgcgatccaattggcccatgcgttctcggtattggccaataacggccgcatggtcccgctgagcctgatccatgtcgacgaaccgccgcaagccacccaagtcatgccggagaacgtcgccaagaccatccagggcatgctgcaacaagtgatcgaagcaccgcgtggcgtattccgtgcccaggtcccggcgtatcacgtggcaggcaagtccggtactgcacgtaagacctcggtgggtaccaagggctacgccgaaaactcctatcgttcgctgttcgccggcttcggtccgatgagcgatccgcgctacgccatcgtcgtcgtgatcgacgagccaagtaaagccggctacttcggtggcctggtctcggcgccggtgttcagcaaagtgatgtccggcaccctgcgcctgatgaacatcacgccggataacttgccgccgacccaacaagccaacgccggcccaccggccgccgctgtaaaagccaatggagggcgcggctgatgtctctgagcctgaacaagatttttgcccatgccggccgcgatctgctgattcgcgagttgagcctggacagccgtaatgtacgcgccggtgacctgttcctggcggtgcccggcggcaagttcgacggccgtgcgcatatcgccgacgccctgcaacgcggtgcggccgccgtggcctatgaagtggaaggcgccaccgtgctgccgatcaccgatgtgccgttgattccggtcaagggcctggctgcgcagctttccgatattgccgggcgtttctacggtgacccgagccgccacctcaacctagtgggtgtgaccggcaccaatggcaagaccagcgtgacccaattggtcgcccaggcccttgacctgttgggccaacactgcggcattgtcggcaccctgggcacgggcttttatggcacgctgcaaagcggcctgcacaccaccccgaatccgattgccgtgcaagcgaccctggccgacctgaaaaaggccggtgccaaggccgttgccatggaagtttcttcacacggcctggaccagggtcgagttaccgccctggcctttgacgttgcggtgatgaccaacctgtcccgcgaccacctcgattaccacggcaccatggaggcgtacgccgctgccaaggccaagctgtttgcctggaatgacttgaaatgccgggtggtcaacctcgacgacgcattcggccgtcaactggctggcgaagacagcgaagcgcgcctgatcagctatagcctgcaggactccagcgcatatctgttttgccgtgaagcccaattcaatgacgaaggcgtgcgcgccaccttggtcacgccccagggcgagcaccatttgcgcagcaccctgctcgggcgtttcaacctgagcaacctgctcgccgccatcggcgcgttgctgggcctggattacgccctggatgaaatcctgcgcgtgctgccgaagctggaaggcccggctggccgcatgcagcgcctgggcggcggcacgcagccattggtggtggtcgattacgcccacaccccggacgccttggaaaaagtcctcgaagccttgcgcccgcacgccaagggcaaattgctctgcctgttcgggtgcggcggtgatcgtgaccgcggcaagcgtccattgatggccgagatcgtcgagcgtctggccgatggcgtagtcgtcaccgacgataacccgcgcagcgaagacccgagccagattttcgacgacatccgtgtcggcttcaaagatgtcgccaaggccacttttgttgccggccgcggcgccgccattgcccggttgattgccagcgctggtgttgacgacgtggttgtccttgcgggcaaaggccacgaggactatcaggaaatcaacggcgaacgccatgccttctccgatctggtcgaggccgatcgcgccctgaccgcctgggaggccgcccatgcttaaagcgatgaagttcagcgaactggcgcacgcgctgtcggcccgtgtactttcgagcgactgcacgttcactggcgtcagtatcgacagccgcaatatccagccggggcaattgtttgtcgcgctggcaggcccgcgttttgacggccacgactatctcaacgaagtcgccgccaagggtgccgtcggcgccctggtgcagcgcgaagtggcagactccactttgccacaactgctggttgccgatacccgcttggccttgggccaattgggtgcgctcaaccgtgccgccttcgataagccggtagcggccattaccggctccagcggcaagaccacggtcaaggaattgctcgccggtgtcctgcgcacgcgcgggccggtactcgccacccgtggcaacctgaacaatgacttcggcgcaccgctgaccctgcttgaactggccccggaacacacggcggcagtgatcgagctgggcgcttcgcgtatcggcgaaatcgcctacaccgtggcgctgaccaagccccacgttgcaattatcaacaacgccggtaccgcccatgtcggcgaattcggcggcccggaaaaaattgttgaagccaagggcgaaatccttgaaggcctcgacgccgcgggcactgccgtactgaacctggacgacaaggctttcgagacctggcgtgtacgcgccgccggtcgcaaggtgctgacgtttgcggtgctgaatgcggccgccgatttccatgcttccgacatccatgttgacgctcgtggttgcccgtcctttaccttgcacaccccgcaaggtgacgagcacgtgcagttgaacctgctgggcaaccataacgtcgccaacgccctggccgccgccgccgccgcccacgcgctgggcgtgtcgctgttcggtattgccaccggcctgggcgcggtgcagccggtcaagggccgcaccgtagcgcaattggccagcaacggcatgcgcgtcatcgatgacacctacaacgccaaccagtcctcggtctgcgccgccatagacctgctcaagagcttcgatggtcgcaaggtactggtgctgggcgatatcgccgagctgggcgactgggccgagcagtcccatcgcgaagttggcacctacgccgccgccaaggtcgacgcgctctacgcggtcggcccgaacatggcgcacgccgttagtgccttcggccccggtgcgcggcatttcgcgacgcaggctgaattgatccaagcgctggccgctggtgaacacgataaaaacacaaccattttgatcaagggatcgcgcagcgcggtgatggaaaacgtcgtcgcagccttgtgtggctcaagtacggagaaacattaatgctgctgctgctggctgagtatctgcaacagttccacaaaggcttcgcggtctttcagtacctgaccctgcgcgggatcctgggtgtgctgaccgcgttgtgtttgtcgctgttcctggggccgtggatgatccgcaccctgcagaacctgcaaattggtcaatcggttcgcaatgacggcccgcagtcgcacctgtccaagtccggcaccccgaccatgggcggtgcgttgatcctgtcgtccatcggcatcagcaccttgctctgggctgacctgcacaaccgctacgtgtgggtggtgctgctggtgaccctattgttcggcgccatcggctgggtcgatgactaccgcaaggtgatcgagaaaaactccaaggggctgccaagccgctggaagtatttctggcagtcggtgtttggtctggccgcggcgatcttcctctacacaacggccccaagcgcagttgagaccaccctgatcatcccgatgctcaaggacgccagcattcccctgggcattggtttcgtggtgctgacctacttcgtgatcgtcggctccagcaatgcggtcaacctgactgacggcctcgacggcctggcgatcatgccgacggtgatggtgggcggcgccctcggcatcttctgctacctgtcgggcaacgtgaaattcgctgaatacctgctgattccttatgtgccgggcgcgggtgagttgatcgtgttctgcggcgcgctgattggtgctggcctggggttcctgtggttcaacacctaccccgcacaagtcttcatgggcgatgtcggcgcactggcgctgggcgcagccctgggcaccatcgcggtgatcgtccgccaggaaatcgtgctgttcatcatgggcggcgtgttcgtgatggaaaccctgtcggtggtcatccaggtggcttccttcaaattgaccgggcgtcgcgtgttccgcatggcgccgatccaccaccactttgaactcaagggctggcccgagccacgcgtgattgtccgcttctggatcatcaccgtgattctggtactggtcggccttgccaccctgaaactgaggtagaaacgagtgtccctgatcgcttcagaccacttccgcatcgttgtcggcctcggcaagagcggcatgtccctggttcgcttcctggcgaaccggggcacgtcgtttgccgtggccgacacgcgggaaaatccaccggagctggtcacgctgcgccgtgactacccgcacgtggaagtgcgttgtggcgagctggatgtcgagtttctgtgccgtgccgacgaactctacgtgagcccgggcctggccctggcgacaccggccctgcaagcggctacggcgcgtggcgtgaagctgtccggcgatatcgacctgtttgcgcgtaacgcgaaggcgccgatcgtggccatcagcggttccaacgcgaaaagcaccgtgactaccctggttggcgagatggcggctgcggccggcaagcgcgtggccgtgggcggcaatctcggcgtgccggcgctggacctgctcagcgatgacgtcgagctttacgtgatggaactgtcgagcttccagctggaaaccacccacgacctcggcgctgaagtggctaccgtgctgaacgtcagcgaagaccacatggaccgctacagtggcctgccggcttatcacctggccaagcaccggatcttccgtggtgccaagcaatttgtagtcaatcgccaggatgccctgagccgtccgctgatgggcgagggcatgccttgctggactttcggcctgggcaaacccgatttcaaaggcttcggcattcgcgaagagaacggcgagaaatacctggccttcgaattccagaacctcatgccggtgcgcgagctgaaaatccgtggtgcccataaccagtccaatgcccttgcggccttggcgctcgggcatgccgtcggcttgccgttcgacgccatgctcgccagcctgcgcacgtttgccgggcttgagcatcgctgccagtgggtacgcgacctgaatggcgtcagctattacaacgattccaaagccaccaacgtcggtgccgccctggcggccatcgagggcctgggggcagatattgacggcaagctggtgttgatcgcaggtggcgatggcaagggcgccgacttcaaggatcttaaaggcccggtggctgcacattgccgtgccgtggtgctcatgggccgtgattcggatttgatcgccgccgccctcggcgatggggtgccgcaagtacgcgccacctccctggacgacgccattgcccagtgccaggcgttggcccagccgggtgacgctgtgttgctgtcgcccgcatgtgccagtttcgacatgttcaagaactacgaagagcgcggccagttgttcgctcgcgccgtggaggccttggcatgaacatcaacttgcgcaacatcatcaagccgtacccgtcgccgatcatcaccgggcgcggtgtcgaccttgatttcccgatgctcgccggttgcctggcgctcctgggcctgggcctggtgatgatcacttcggcatcctccgaagtggctgccgtgcaatcgggcaacaccctgtacatgatgatccgtcacctggtgtacctggtgatcggcctcggcgcgtgcatcgtcaccatgatgatccccatcgccacctggcagcgcctgggttggctgatgctgatcggcgcgttcggcttgctggtcatggtgatcctgcccggcatcggtcgcgaggtgaatggctcgatgcgctggatcggcttcggcgcgttcaacgtgcagccttcggaaatcgccaaggtgttcgtggtgatctacctcgccggctacctggtgcgacgccagaaagaagtgcgcgaaagctggatgggctttttcaagccgttcatcgtgctgctgcccatggccggcctgttgctgatggaaccggacttcggcgccaccgtggtgatgatgggggcggcggcggcgatgctgttcctcggcggcgtcggcctgttccgcttcaccttgatggtggtgctggcggtggcagcagtgacgattctggtacaggcgcaaccctaccggatggcgcgcttgatcacctttaccgacccctggtccgaccagttcggttccggctatcagctgacccaggcactgatcgcctttggtcgcggcgagtggctgggcgtgggcctgggcaacagtgtgcagaagcagttctacctgccggaagcgcacaccgactttgtgttctcggtattggccgaagagcttggcgtggtcggttcgctgtgcaccgtggcgctgttcgtgttcgtgtgtgtgcgcggcatgtacatcggcttgtgggccgagcgggccaaacagtatttcgccgcctatgtggcatacggcttgtcgttcctgtggatcggccagttcctgatcaacatcggcgtgaacgtcggcctgctgccgaccaagggcctgaccttgccgttcctcagttacggcggcagttcgttggtaatctgctgcgcctgtcttggcttgttgctgcgtatcgagtgggagagtcggacccacctgggcagtgaagagatggagttcagcgaaagcgacttcgccgaggagccgacccatgggcgctaacgtgctgatcatggccggcggcaccggggggcatgtgttcccggcccttgcttgcgcccgtgaattccagaaccgcggctataccgtgcactggttaggtacgccccgtggcattgaaaacgagttggtgcctaatgccggtttgcccctgcatttgatcaacgtcaccggcctgcgtggcaagggcaagttgtccctgctcaaggctccgtttgtgttgctcaaggcggtcatgcaggcacgcaggatcattcgtgaattgaagcctgtgtgtgtgcttggctttggtggctacgtgaccggcccgggcggcgtcgcggcgaagctcgccggcgtaccggtgatcgtgcacgaacagaacgccgtcgccggtaccgccaaccgcctgctggtgccattggcctcgcgggtgtgtgaagccttcccgaaaacgttcgccgcctcggacaagctgcgtaccaccggcaacccggtgcgtactgagctgttcatggccattgcgcgtgatgcgctggccgggcgcaaggcgcacctgttgatcctgggcggaagcctgggcgccgaaccgctgaacaaactgctgcccgaagcggtggcgcagctgcctgtgcaattgcgcccggagatcttccaccaggctggcaagcatcacgatgaagtcaccgcgacgcgttatcgcgaggcgggtgtggaagcgaatgtgcagcccttcatcaaagacatggcccaagcctatggctgggccgacctggtggtctgccgcgctggcgcgctgaccgtcagtgaactggccgccgccggtctgccgtccttgctggtgcctttgccccacgccatcgacgatcaccagacccgcaacgccgaatatttggccggggagggcgctgccttcctgctgccgcaaagaacgaccggcgccgccgatttggccgcacgcctgaccgaggttttgatgcaaccggaacgactcaacagcatggcgagcaccgcaagccgcctggccaaacctgacgcaacccgcaccgtggtggatatctgcctggaggtggcccatggttgagaatcagaaagccatgccgcaacccgagatgcgccgcatccggcgtatccacttcgtcggtatcggcggcgtgggcatgtgcggaattgccgaagtgttgctgaacctgggctaccaggtgtccggctcggacttgaaggagtcgccggtcactgatcgcctgaagtcctttggcgcgcagatctttatcggtcaccgtgccgagaacgccgccgaggccgacgtactggtggtgtccagcgccgtgaacacctccaatccggaagtggccactgcccttgagcgccgtattccagtggtgccgcgtgccgagatgctcgccgagctgatgcgctaccgccatggcatcgccgttgccggtacccatggcaagaccacgaccaccagcctgatcgcctcggtgttcgccgccggtggcctggacccgaccttcgtcatcggtggccgcctgaatgcagccggcaccaatgcccagctcggcaccagccgctatctgatcgccgaagccgatgagagcgatgcgagcttcctgcacctgcaaccgctggtcgccgtcgtcaccaacatcgacgaagaccacatggcgacctacgacggtgacttcaacaaactgaagaaaaccttcgtcgatttcctgcacaacctgccgttctacggtctggcggtggtgtgcctggacgacccggtggtgcgtgaaatcctgccgcaggtcaagcgtccgaccgtgacctacggcttcagcgaagacgccgatgtgcgcgcaatcaatgtacgccaggaaggcatgcaaaccttcttcaccgtgctgcgtcccgaccgcgaaccgctggatgtctcggtgaacatgccgggcaaccacaacgtgctgaactccctggcgaccatctgcatcgccaccgatgagggcgtcagcgatgaagccatcgtcgaggggctgtcgcgctttgctggtgtcggtcgtcgcttccaggtctacggtcagttgccggttgaaggcggtgacgtgatgctggtggacgactacggtcaccacccgaccgaagttgccgctgttatcaaggccgtgcgcggcggctggccggagcgccgtctggtgatggtttaccagccgcatcgctacagccgtacccgcgacctgtacgacgatttcgtcaatgtactggccgatgccaacgtgctgctgctgatggaggtttacccggccggtgaagaaccgatcccgggcgctgacagccgcaagctgtgcaacagcatccgccagcgcggccaactggacccgatctacatcgagcgtggcgtcgacctggcccctatcgtcaagccgctgttgcgcgccggtgacatcctgctgtgccagggtgccggtgatatcggtggccttgcgcccaagttgctggcgagcccgctgtttacagccgtggcaaagggggcgtcgaaatgatcactgactacggctccctgttttccactgtcgcgcctgccgatttcggtcgcgtcgccgtgctgttcggcggcaagagcgctgagcgcgaagtatcgctcaagtctggcaatgccgtgctcgaagccctgcaaagtgcgggtgtgaacgccttcggtatcgacgtgggcgatgacttcctcgcccgcctgcaggccgaaaagatcgaccgcgccttcatcattcttcatggccgtggcggtgaagacggcagcatgcaaggcctgctcgaatgcgccggcatcccctacaccggtagcggtatccttgcttccgcgctggcgatggacaaattgcgcaccaagcaggtgtggcacagcctgggtattccaacaccacgtcacgccgtgctgtgcagcgaagacgattgtatttctgcggccaaggaactgggcctgcctttgatcgtcaaaccagcccatgaaggctccagtatcggcatggctaaagtgaactcggccgccgaattgatcgacgcatggaaagcggcaagtacctacgattcgcaagtgttggtggaacagtggatttccggtcccgagtacaccatcgccaccctgcgtggccaggtattgccgcccatcgctttgggcacgccccacaccttttatgactacgacgccaagtacgtggcctccgatacccagtaccggatcccgtgcggcctcgatgcaaccaaggaacagcaattgatggacctcacggcaaaagcctgtgaggcgctgggtatcgccggttgggcacgggcagacgtgatgcaggatgaccaagggaatttctggttccttgaagtcaacaccgcaccgggcatgaccgaccacagcctggttcccatggccgcccgtgccgccggtctggacttccagcagttggtgctggcgatcctggccgacagcattgagccaagaggctgaacacatgaaaggcgcatcgcttcgtcatcagcccccacaagcaccgagccgcaagccggtgccgcggggcgccagccgaatggtggctaaagagccgatgtcggcgcgcctgccgaaagccaactttggttttatcaaggcgctgttctggccggtgctgctggtggtattgggctttggtacctacgaaggcgcgcagcgtctgttgccgtatgccgaccggccgatcaccaagatcagcgtgcagggcgacttgagctacatcagtcagcaggcggtacagcagcgcatcggcccgtacctggcggcgagcttctttaccatcgacctggccggcatgcgctcggagctggaacagatgccgtggatcgcccacgccgaagtccgccgtgtgtggccggaccaggtgacgatccgcctggaagaacaactgcccgtggcccgttggggtgatgaagcgctgttgaacaaccagggccaggcgttcaccccgcgtgagctggccaactacgagcacctgccgcagctgttcgggccgcagcgggcgcagcagcaagtgatgcagcagtaccaggccctgagccagatgctgcggccactgggcttctccattgcacgcctggaattgcgtgagcggggcagctggtttttgacgaccggggcaggcagttccggcccgggcatcgagttgttgctgggacgcgaccgcttggtggaaaagatgcgccgctttattgccatctatgaaaaaactttgaaagaacagattacgaacattgcgagcgtcgacctgcgttacgccaacggcctggccgtcggctggcgtgcaccggctgcgcccacggcagcacaacccgctgtcgcgaagaattaagaagaggcaggacccatggcaaacgtgcaaagcggcaaaatgatcgtcggtctcgatatcggcacctccaaggtggtggcgctggtgggcgaggtcggggaagacggcgcgatcgaaatcgtcggtattggcacgcatccgtcccggggcctgaagaagggcgtggtggtgaacatcgagtccaccgtgcaatcgatccagcgcgccattgaagaagcgcagctgatggccggttgccggatccactcggcgttcgtcggcgtggcgggcaaccatatccgcagcctgaactcccacggcatcgtggcgatccgcgaccgcgaagtcagctccgccgaccttgagcgcgtcctcgacgccgctcaggccgtggcgatcccggctgaccagcgcgtgctgcacaccctgccgcaggactacgtgatcgataaccaggaaggcgtgcgcgagcccctgggcatgtcgggcgtgcgcctggaagccaaggtccacgtggtgacctgtgccgtcaacgccgcgcagaacattgaaaaatgcgtgcgccgctgcggcctggaaatcgacgacatcattctcgagcagctggcttcggcgtactcggtgctgaccgacgacgaaaaagaactgggcgtgtgcctggtggatatcggcggtggcaccaccgacatcgcgattttcaccgagggtgcgattcgtcacaccgcggtgatcccgattgccggcgaccaggtcaccaacgacatcgccatggcgctgcgtacaccgacccagtacgccgaagaaatcaagattcgttatgcctgcgccctggccaagctggccggtgccggcgagaccatcaaggtgccaagtgtcggcgaccgtcctccccgtgagctgtcgcgccaggccctggccgaagtggtcgagccacgctacgacgaactgttcaccctgatccaggctgaactgcgccgcagcggctacgaagacctgatcccggccggcatcgtgctgactggtggcacctcgaagatggaaggcgcggtcgaactggccgaggaaatcttccacatgccagtgcgcctgggcgtgccccatggcgtgaaaggcctgggcgacgtcgtgcgcaacccgatttattccaccggtgtgggcttgctgttgtacgggctgcagaagcagaccgacggcatttccctgtcgggcccgagtatccgcgacagctaccgcagcgacgacgaagtgaaagcgccgttgttcgagcggttgcaggcttgggtcaaaggcaatttctaaagatttaccgcgacaccgcagcacccgcagtaagcagtaggcgaaaaaactagagaaaatgaaaggagagggaacatgttcgaactcgtagacaacatccccgcaagcccggttatcaaagtaatcggtgttggcggtggcggcggcaacgctgtcaatcacatggtcaagagcaacattgaaggcgttgaattcatctgcgccaacactgatgcccaggcgctgaaaagcatcggcgcgcggaccatcctgcaattgggcacagccgtgaccaagggcctcggcgctggcgccaatccggaagtcggccgtcaagccgccttggaagaccgcgagcgtattgccgaagtgctgcagggcaccaacatggtgttcatcaccaccggcatgggcggcggtaccggtaccggtgctgcaccgatcattgccgaagtggccaaggaaatggggatcctgacggttgccgtcgtgacccgtccgttcccgttcgaaggccgcaagcgcatgcagatcgccgacgaaggtatccgtctgctgtctgaaagcgtcgactcgttgatcaccatccccaacgagaaactgctgaccatcctgggcaaggacgccagcctgctgtccgcgttcgccaaggctgacgatgtactggccggtgccgttcgcgggatctccgacatcatcaagcgcccgggcatgatcaacgtcgactttgccgacgtacgtaccgtgatgagcgaaatgggcatggcgatgatgggcactggctgcgccagcggtccgaaccgtgcacgcgaagccaccgaagcggccatccgcaacccgttgctcgaagacgtgaacctgcaaggcgcacgcggcatcctggtgaacatcactgccggccctgacctgtccctgggtgagtactccgacgtgggtagcatcatcgaagccttcgcttccgagcacgccatggtcaaggtcggtaccgttatcgatccggacatgcgcgacgaactgcacgtgaccgtggttgccaccggcctgggtgcgaaaatcgagaagcctgtgaaggtcatcgacaacaccctgcataacagccaggccagccacgccagccaggcggccgccgctccagcacctgctcgccaggagttgccatcggtgaactaccgtgacctggaccgtccgaccgtgatgcgcaaccaggcccaggccggtgctgctgcgtcccgtagcccgaatccgcaagatgacctggactacctggacatcccggcattcttgcgtcgtcaggccgattaatggaatgtatcagggctatgaaggtgattggtgttcagcaaaggtctggtctgctattatcgccagcctttgttgataccagttcgcaatttgcgctgaagcggtccaagccatgattaaacaacgcaccctgaagaatattattcgtgccacaggtgtaggtctgcactccggggaaaaggtctacctgaccctcaagcctgcacctgtcgacaccggcatcgtgtttgtgcgtgccgacctggaccctgtggtgcagatacctgctcgcgcggaaaacgttggcgaaaccactatgtcgaccacattggtcaacggtgacgtcaaagtggacacggtggagcacttgctctcggccatggccggtttgggcatcgataacgcctacgtcgagctctccgcgtccgaagtcccgatcatggatggcagcgctggacccttcgtattcctgattcaatctgccggcctggaagaacaggacgcagccaagaagttcattcgcattctgcgggaagtgacagtagaagacggcgacaagcgcgccaccttcgttccgttcgaaggctttaaagtgagctttgagatcgatttcgatcacccggtattccgtgaccgcacccaaagtgcaagcgtggatttttccagcacttcgttcgtaaaagaagtcagccgcgcccgtacctttggtttcatgagtgacatcgagtacctgcgcaagcacaacctcgcactcggcggcagcgttgaaaacgccattgtggtcgacgcggatggtgtactgaacgaagacggccttcgctacgaagacgaattcgtgaagcacaagatcctcgatgcaatcggtgacctctacctgctgggcaatagcctgataggcgagttcaaaggcttcaagtcgggccacgcccttaacaaccagctgctgcgcaagttgattgagcagacagacgcttgggaagtcgtgaccttcgaagatgccagcaccgcaccgatctcttacatgcgtcccgttgcggcggtgtaagtaacaactctctttctttagttttaaaggctgccttcgggtggcctttttttatgcctcgtttataggggcgcggcatccacaatccgattgcgccccgtgtgcttggcctcatacaacgcctggtcggccttgagcagcatactctcaagggacataccgctacgtttctgccaggtactcatgccgatgctcacggtaaccggctgtttatccccagccacccgtggcaaacgctcgacgctgatgcggatgcgctcggcgatcacccaggcgcccttggcgtcggtatggggcagcaccacggcaaactcttcaccgccatagcgtgctgccaggtcggccggacggcggatattgctgtcgatcacctgcgccactgcgcgcaacgcatcatcgccaccctggtgaccatggcggtcgttgaaggccttgaagtggtccacatcgatcatcaacacggtcaagggctccgtcgagcgctgtgcccggtcccactccaggcgcaggcgctcgtccagggtacggcggttggccaggccggtgagggcatcagtggctgccaattctgacagcacctgttcagcgcgatgacgacggcgcagctccatgcacagcgcccaggtcagccacaacaggcctacgcacagcacgcctgtggcgatgctcaccagccacgccgcacgccgccatggcgcaaatatctcattgctggacaaagccaccgcgacgatcagcggcaggttgcccacactggagaaactgtagagtcgcgcctggtgatcgacactggagatactctggaagctgccatcgcgctcgcgcagcatgcgtgccacattggggcgctggctcaggtctttgtcgagcatgcctgcttccagcaaaggttcttgggccaacaggatgccttggtggttgagcaggttgatcgtgctgttgctgccgatgttcaggctgctgaacaactggtggaagtacgacaggcgcatggaggcggcggcgacgcccaggaagcgcccgtccggcgacgaaacgcggcggctgaacgcgatgcgccatgggtcatcgcacacacagcgggccatgaatggacggcttatatataaccccgcgtccggattttcgcggtgcacctgaaaataatcccgatcagagaagttacccagcttgggtgtgagcagggacgaatcggcaatcacctcgccgttcgggctcagcagcaggatatcgcccttgtacggcgccgccgccgagcgatcgaacagcaccagatggcggatgctcgctgaaacgtcttgcaggtcagtgcgctcggtggcggcgatcaggcctttgagggccatgtcgtagagctccacgttgcgcagcacgtcggcatcgatcaattgcgtgatggtattggcggtgcgcttggccgtctgcaaggtattggcctgttcccgaatcagcagcgcggtgacgatccccacgatcagcaacactgtcagcgtactgcccaggatcagcaagcgctccgggcggcggtcaggacgggttaggcttgggctcatcggacgcacttctgctttggggatgcccatagcttagtagtaactctggaataggtcgcagaaccaaaatgtgggagcaagcccccacattaggaacgctgtcagaagacgttgatggggtagtccacaatcacgcggtactcatccacgtctcgatccactgccgaatagccattgctgcctcgattggtcgcccattgcaggcgcaccgacaggtccttggccttgccgccttgcactacatatttcaaatcgatatcccgctcccagtgcttggcatctttgccatcggcgctgtaccagctgctatagccgcggctgttggggtcgaccttggtcaggtcggtcttgccgctgatgtaggacacagcggacgtcaggccaggcacaccgaggccggcgaagtcgtaggcgtacttgagcttccatgagcgctcgttggggccgttgaagtccgagtactgctgggagttatccaggtaaatgctgtcgccctgggcgatgtagtcgaacggcgtgttgccgttgacccgctggtaggtggccgtgacgctgtggttgcccacgccgacagtgaaatgcaggctgtaggtgttgttgtcgatatcccccagcagggattggccggtgtcctgggtgtggtagtagtgcaggcctggggtcaggctgaccaggtcattgagagcataggtgtattcgaggtcgtagtagtactgatgccatacgtccttgagttcggaggcgtacaggttgctggtcagccccgtgataccgctgaacgatacgccggcccagtccaggtgctggctgtcggcgttggcgggcaaggcgccataactggtgccgatgcgccggtggccgctctggttgtagagcttggtgaagctggcctggccgccctcgatcatccaaccgtcgaagctgtggttggtcacactcacaccacggaaggtctgcggcagcatgcgggtcatgccgccggcgatcaccgggttattgaggaacaggtcgccggctttcagttcggtatcgaaggcacgcattttcaaggtgccgccggcggtagagaacgatccgggtgccttgccgttgccactgccgtagggaaggatgctggagccatcggtgccaccaccaccgtcgagcttgaggccgagcattgcattgaggtccaggccgaagccgacggcgccttgggtgtagccggactcgaaggtgccgataaaaccctggccccattccttgctgtcatcggtatgaatgtcgcgacggtcgcggttcatgtagtagttgcgcgtattgatcgtgaggtggaagccttcaacgaaaccgtcggtgggggtggtgtctgccgcctgggcgaggggagtgatcgttgctgcaactgcgaggaataacggggtgaacgtcagcgagttcttcaccggtggagctcctttggtcaatcaagaacggccagtgtcgtgggggtgtgcctggcctttttttacggcaaaaaaaagccgctgaagtcagcggctttaagacagattcccagtgtagagccctggaaaaaagtcgagggaaattcgggtaagcgggtcagctgtctttgccgtcgcgctcatcgatgcgtcaaagtaacgcaggcgagcggtgcgatacagagtgtaacaagataataactattgcccaaactgtaacagttagacgaaggatctgcgtaaagctaactggggaggtgttcccaagtttagacgggcagagtaatgccaaaggtattaccgccgtgctcactacgcacaaacacatcccccccatgcatcaacgcaatcgccttgacgatggccagccccagcccgtggttcgctccgctgttgctgcgcgacgcatctacccgatagaaacgttcgaacaggcgcggcaagtgctcgcgggcaatcgcctcgccagggttggtcacgccgattaccacttgttgctcccgcacctcgatgttcacgtcgatcacctgccccgcagcggtgtgctgcaccgcattgctcagcaggttgatcagcgcacgccgcaggtgggccttttcgatctgcacccgggcatcgccgtgcacgcgcacttcaacctgggcgtcttcgaggatgaaatccaggtaatcgagggtcgtcgctacctcatcagccagggagctttcgatcagcttggtggccttgctgccctggtcggcgctggcgaggaacagcatgtcattgatgatcgagcgcagccgttccaactcttccaggttcgattgcagcacctcgaagtactgctccgcggaacgcccgcgggtgagggcgacctgggtctggccgatcaggttggtcagcggcgagcgcagttcatgggccacatcggcattgaaggattccaggcgtgagtaggcttgttcgacgcggtcgagggtggcgttgaacgagttgacgaactggctcagttccggcggcagcggtgacagatgcaggcgcccggagagtttgggtggcgcaagtttctgtgcctcatccgagagcttacccaggggcttaaggccgatacgcgcgacccagaaccccagcagcgccgccagcaccacgccgaccagcgccaggctgaccaacgctaccagcaggtggtgctgggtggcgcgaaagttttcggtgtcgatggcgatcatgaagcgcagcgccggacgttggtccttggccgcaaactggctgaccagcaccttgaacggataatcatggccgggcaggcgcaggtcgcgcttgcctgtcggaccctgtgcaaaggcgcggatttgcgcatcgggctcgccgtattcatagctcgggtcactgctgaccacccagaaacggatacgcttgtcttcttcgcccagcaacttgagcttggccttgatcttgacccaatgctccggcgtaccgaagcgattgaccgacgattccagcacgctgtagcgcgcatccaactcggcctcgggcaacaaccccaggccgcgatccacctgctgatacagcacgccgccgatcagcacgaagatcagcaacgccaccagggtgaacatgccgctcaggcgcagagcaatggaattagccgacactacggttctccagcacataacccatgccgcggatggtgtgcagcagcttgtgttcgaacggcccgtcgagcttggcgcgcaggcgcttgatcgccacttctaccacgttggcatcgctgtcgaaattgatgtcccagaccatctcggcaatggcggtcttggacaggatctcgccctggcgccgcgccaatacgctgagcagcgagaactccttggcggtcaggtccaggcgttggccgttgcggctggccttgcggctgatcaggtcgatccacaagtcggctaccgtaacctgcactggctcgtggccgccgctgcggcgggtcagggcttgcaggcgcgctaccagttccaggaacgaaaacggtttgcccaggtaatcgtcggcgccttcacgcaggccgcggatgcggtcttccacgcgctcgcgggcggtgagcatgatcaccggcgtctgcttgcgggcgcgcaacgcacgcaacacaccaaagccatccaggccgggcagcatcacatcgagcacgatcaccgcgtaatcgttttccagcgccaggtgcagaccctcgacgccttcacgcgccacgtcgacggtgtagccttgctccgtaaggccgcggtgcaggtagtccgcggttttctcttcatcttcaataatcaggacgcgcatgaccgcctcagtgtgtggtcgccagcgccagcgctggtttgggcctgtggaaaaaccgttcaaggtacaagtatatgaccggcgtagtgaacagcgtcagtgcctggctcaccagcaagccaccgactaccgcgatgcccaacggctggcgcagttccgcacccggccccgagcccagcatcaacggcactgccccaagcaaggcggcgagggtggtcatgatgatcggccggaaccgtgtgacgcaggcttcgtaaatcgcatcctccggcggcaacccgcgtacgcgttgggcttccagggcaaagtcgatcatcaggatgccgtttttcttcacaatgccgatcagcaataccaggccgatcaaggccatgattgaaaaatcctggcccagcaaccacagcatgaccagcgcaccgaggcccgccgaggggagggtggaaatgatcgtcagcgggtgcacgaaactctcgtacagcacacccaggataatgtagaccgccaccagcgccgcaaggatcaaccacggctggctggccagcgaactctggaacgcctgggccgcgccctggaagttgccgatcagggtactcggcatgccgatgtcgttcttggcctggtcgagcatgatcacggcatcgcccagggccacgccgggcgccaggttgaacgacaggttggcggcggggaacatgccgtcatgactgatggacagcggcccgacagtgggcgggtcgaccctggccagcgccgacaacggcaccatctcgttggtcagcggcgaacgcaggtagaagtaattgaggctttcggctttgccgcgctgttggctgtccagttcgagtatcacttggtattggttgatctcggtctggaactcgttgatctggcgctggccaaaggcgtcgtacagcgcctggtcgacatcggtggcggtcaggccgaagcgggcagcggcctggcggtcgatactgatgtgggtgatgctgccgcccagttgcagatcattggacaggtcgcgaaacgccgggttggcgcgcagtttttcggtgaggcgttgggtccaggtgttcagcgtcgggccgtcattgctcttgagcacatactggtactgggcgcggctggggccggagctcaggttgatgtcctggccagcgcgcaggtacagcacgatacccggcaccttggccagttgtgggcgcaggcgatcgatgaattggctggcagatacgtcacggtcaccgcggtctttcaaggcaatccagaagcgcccgttggcgatggtctggttgctgccggtgacgcccactgagtgggagaaggcttgcactgccgggtcggccttgacgatctcggccagtgccttgtgcttggcgaccatgtccggatacgacacatcggccgccgcctcgctggtgccgagcacaaagccggtgtcctggaccgggaagaaccccttggggataaacacgtagccgaccacggccagggccagggtcaccacgaagatcgcggccatgctgcgttgatgcgccagcgcacggcgcaggttgcgtgcatagccggccagcaggcgttcgctgaaggtgggcttggcgtgggcgtgatgggtgggtgcacgcatgaacagggccgccaatgtcggtgccaaggtcagcgaaaccaccaccgaaatcaggatggtcgaggtggctgtcagcgcgaactccttgaacagccgcccgaccacgccgcccatgaagagcagcggaataaacgccgccaccagcgagaagctgatggacaccacggtaaagccaatctcgccggagcccttgatcgcggcttcgcgcttgcccaggcccgcctccaggtgccggtgaatgttctccaccaccacaatcgcatcgtcgaccacaaagcccacggcaatcacgatggccaccaaggtcaggttattcaggctgaaccccatcaggtacatcagggcgaaactggcaaccagcgatacgccaagcacagccgacacaatcagcgtcgccgacagctggcgcaggaacagcgccatgaccgccaccaccagcaggatagcgatcagcagggtcatttccacttcatgcaatgaggcgcggatggttttggtgcggtcggtcaatacactcacctgcaccgaggccggcaacatgccttgcaggcgcggcagttcggcttgaatgcggtcgacggtctcgacgatgttggcgccgggctgacgtgaaatcaccaggttcacgcccggggtatcgccggaccaggcttgcacgtaggcgttttctgaaccattgacgactttggcgatatcacgaagttgcaccggcgcgccgtccttgtaggaaacgatcagctgaccgtattcctccgggtgaaacagttggtcgttggtcgacagggtcgacacgctgttctcgccatagatcgcgcccttggccaggttcaggctcgattgctggatggtcaggcgaatatcggcgagggtcaggccgatggccgcgagcttgtcaggggatgcctgcacacgaatcgccggacgctgctggccggtgatgttgatctggccgacgccgtcgatctggctgatctggcgcgccagcagggtttccacgtagtcgctcagttcggtgctgggcatgctatctgagctgacactgaggatcagcaccgggctgtccgccgggttgacctttctccaggtcggcaaactcggcatatcgctgggcagcttgcccgatgcggtgttgatggcggcctggacttcctgggcggcggtgtcgatgcttttttccagggtgaattgcagggtcagttggctggaccccagggcgctgctggaagtcatctgggtcatgccggggatggcactgaattgcacctccaggggcgtggccaccgatgaggccatggtgtccgggctggcgccgggcagctgcgcggtgacctggatcgttgggaattccgcttccggcaggggcgctacagccaggcgcgggaaggcaatgatccccagcagtacgagggcgaaggtcagcagcagggtggcgaccgggtgatcaacacaccaggccgagggcgaacggccgccgttcatggttgcaccttggcgtcagcggtctggattacttgcggcggctccttgagcacctccacccgggcaccggccttgagccgcgactggccgtcgctgaccagcacatccccggcctgcacgcccttgataatgttgatctcgctgtcctggtaggcgacctgcaccggcaccacctccacggtgtcatcgctcacccggtacacgaagtgcgagtccaggccacgctgcaccacggtcggcggcaccaccagggcgttcctgtcgagggcggtctggatcttgatggtcaccagttgccccggccacagcttttgcgatgggttattgaactcggccttggcccgcagggtgccggtggtggaactgatctggttgtcgatcaggctcaggtggccttcgccgagcaggtcgccggtctggccgtcggtgtcggcgcccaggtaggcatcgacacttgcccgggtcggcgcggcaatcaggccctgcaaggtcggcagcatctgctggggcagggagaacgtcacggctatcgggtcgatctgggtgactgaaaacagtccctgggtgtcgctcatgcgcaggaagttaccttcatccacgctgcgaatacctacgcggccactgaccggggatcggatctgggtgtaggaaagttgtacctgagccgcatctatcgcagcctggttgccttgcgccgtggccttgagctggttgaccagtgcctgttgctggtcataggtctgcttcgacacgccgtcgtcaatgctcagctccttgtagcgcttgaggttgaccagtgccacttgcagttgcgcctggctttcgcccaattgcgccttggcctggtcgaggctggcccggatagagcggtcgtcgatgctagccagcaagtcaccggcttttaccagttggccttccttgaccagcagtttggtgaggatgccgtcgatctgcggacgaatcaccacactgtgcaacgacaacaccgagccgatgccgctgacgtaccgcgcaacatcctgctgcaccacgctcaccacccgaaccggaattgcgctgggtgctgccagccgggtcttggctgggcgggtcaacgcccaggctgcaacgcccagtatcaggagtacgcctactatcaaggccgtgtttcgttttatgtgcatggaaagacgccagcggcgcagttgcaggtttcaagctgcacgctgcaagttgaagttagaatgagtgctttatagcgctgtcatgcggtcagcacagtgacggcaaactgacagcggtgacagctgggggttgaacttgcggttgaagcttaccgctggcagctccagccccgtatactcgcgtttttacgcctatagctgcgccggagcccctatgtcttcccccacccaaccccctgtcgaagcggccgaactcgtcgacctggccactgccgatggcgttgaaaaagccgagatcccggcgttcaagttccccttcaagccgggcgagctggccgcggtcaagcatgccggccagccttggtacaaaggcggtgccaagaatggccatgccaagacgccaggtatggcgccacctggcactcgtcgttccatgggtaaacgttaggatcaaagcttgttgcgctgtatcggctgttgcctacagcgcgcgtagatatttctgattgtaggtccgcgaccatttcttgaaagctggcacagtactttactccgccccaatgatgctcatcgggtgcggtgagccagtttttcccggaaaaggacgttcctgtggccctgatacacatttgtgctgtgtttgctctcttgctgtcgacgactgttgctgccgccagcgatcaaccacgacacgaaatccgtttcgccgtcgccgcgcacttcccgccgttccaacaccgcaactcccaagggcaactggtggggttgaatatcgaactgggtaacgccctgtgcgagcaactcaacgtgcgctgtacctgggtcgaccaagtggtcatggaaaatttcccggccctggacggccgaaagttcgacgcgatcatgggcatggcgccgacgtcgaatcggcgacaacaggtgagctttaccaatgcgctctaccccatcaccacccgcttggtggcccgtaaaaccgcaggcctgacccctgatcggcggtcgctcaagggcaagcgtgtcggggtcttgatcagaagcaatcgtgaagcctttgccctgtcgcagtgggcgccggcaggcgtgatcatcaagagtttctggctcaatgatcaactgatcaacagcctcctcgcgggcgatatcgatgcgaccctgcaaggtgcggtagagatacgtgaggccctgctggacacggctcagggcctggatttcgattttctcggcccggttgtttcgtctgacctgttgggcgacagcgtggcgatcgcagtgcgcaagctcgatacctcgttgcgcaatgaactcaaccatgcgcttgaagagctgatgcaaaacggtgaataccagcgcatcgtcgagccctatcgtctcgatgtgctgccatccagtccgtgatggctgggggcgagcccccattgacatgaggcgcacccgccaaacccccatcagcggtcaggccgccctcagtgagataaacgcatagttggccggcacctcggtggcaatctgcgcaccagcgtccagcagttgttcggcgatatccatcccggacacatggaacacccattcagtgggcatggctggctggtcggtcgcctgctcaatggcgtgggtgaatgcctgcatatctggcaggtacgcggtaaagccatcgcccttgagcgcagttgtccgaatgccgagcaacgcgcacaccgcctccttggcctgcacatcatcacggtcggcctggcgcgaacgacggatcagttcaaccagttccaggtccatcagttcgccaccaacgatcagcgccggaccctgttcccaggactgcggcgggcaatccttggcactcgggttcagcgggatatgcgggttgatctccatcggatagatccggcacaccagagggcgtcgttcgtagatgcgacagcggttgtcttcgtcaagattccggcaggggccggcgttgtaggcggcaaaggtgattgccacgaacgcctcggtattgccgctgggcacgatcactgaacggcgctcggcgtgttcgcgttgttgcaggggcaagcccaggccgttacgcaggaagccttcgaccagaacgatgacattaccgccgtccgccgcccattgccgggcctcttcgagggtcaggggcacgtgatggtcgttgcagcatttgccgcaacctacgcaggaaaaatgagtgttcatggcggatctgtcaccaggcaagttcagaggggacgcttgaggagtgacgggtttttacctctatccaccgctcgggctctctggaagcaagttatgcgccagtggttatcagtccttggtcactatgtcccgcaggacaaatttcatacccgcactttcatacagctgccgggcacgcaggttgctctccagcaccttaaggtccacataaggttcgccgcgctgcttgaacatctggaaggtctgcagcaacaaggctcggcccagtccctggccttgggcgcaagggtgcacggagaggttcttgataaaggcactggtccagcattgcgccaccccgaggatgccgccggcgttactggctaccaggcacagtgtcggatcgaactcggcattggtgacgaattgccggcgccattcatccagccgggcgacacggccgccgccctggtcctgggtcatgcgcagcacggcatggattgccggggccagttcatcccggtaatgatccagctgcgtatccgctggccactgcggggcggtcaggctgcctgtgaggtcgcgacgcagcagctggaaataatcggccaacgcctacaggcccttttgcgccacggctttggcggccacgaccaggcacttggtcagttccggcgatgagaacttggtcagcaccgcatcggcaccggccaggcgggctttttcgctgttcatcgcgctgtccagggaagtgtgcaacagcacatagaggtcctggaagtctggggtttcgcgcagggtacgggtcagggcgtagccgtccatctcggacatttcgatgtccgacaccaccacgttgatttgctcgccggtgccttgcagctccagcaacacgtcgatggcctccttggcgctgcgggcggtgtggcaggtcagaccgaggttgcgcagggtgtgtaccgattgctgcagggccacctggctgtcgtccaccaccaggatgcgcgcattgcccagtacttcggcttcttccatggtcaggtcggtcggcgccgcttcaatcggtgccggggcgatgccgtggatgactttctcgatatccagcacctgcaccaggccaccttccacctgggtcaccccggtgataaacgcccgattgccgccagaaccgtaggggggcgggcggatatcggtggtcaggcaatgcacgatcttgctcaccgcctgcacatgcaggccctgcttggaacggctgacatcggtgacgatcaggcagccgccgtccgggtcttgcaagggcatttcgcccagggcgcggctcaggtcgatcaccgaaagtgaagcaccgcgcaaggtggcgatgcctttgacgtggggatgggactccggcagcttggtcagcggcgggcagggtatgatttcactgactttcaacaggttgatagccatcagcttgccgctgcgcaaggtaaagagcagaagcgagagtgagtctgcgcgggctttagtggtggacataaaaaccttctgtggatcagggatgacaatcatctatggaaggttatcgactcggctggcctgggctttaaccggattttgtgtcgggcactgctaatgtgggagggggcttgctgccgatagcggcgtgtcagccagcagatgtacaactgatccaccgccatcgggagcaagccccctcccacattgggttatgtatcagcctttccaggcctggggattcaccagatcctgcgggcgctggcccagcagcgcgctacgcaggttggccacggcgcggttggccatggcttcgcgggtttcgtcggtggccgagccgatatgcggcagggtcacggcattgctcaactggaacagtggcgattcggccagtggttccttttcatacacatccaggccggcaccacgaatacgttgggtttgcaacgcttcgaccagcgccgattcatccaccacgggcccacgggaaatattgatcaggatcgcgctggacttcatcagacccaattcgcgagtgctgatcaggtgttgggtcttgtcgctcaatggcaccaccaggcagacaaaatccgcctcggccagcaactggtccaggctccggaactgcgcgccgagctcttgttccagcgcggtcttgcggctgttgccgctgtacaggatcggcatgttgaaccccaggcgtccacgccgggctacggctgcgccgatattgcccatgccgacgatgcccagggtcttgccgtgcacatcgcagccaaacaacggtgcgcccacgctggctttccagtggccggccttggtccaggcgtccagctcggccacccggcgtgcgctgctcatcagcagggcaaaggccaggtcggcggtgctttcggtgagcacatcgggggtgttggtgagcatgatcccgcgctcattgaagtacggcacgtcgtagttgtcgtaacccaccgacacactggacaccacctccagcttgctcgcgccttcgagctgctcgcggccgagcttgcggcccacacctatcaagccgtgggcgtggggcagggcttcgttgaactgtgcgttgatatccccctgtttgggattgggcactatcacctcgaaatcctgttgcaggcgttcgatcatgggcgcggtgatgcggctgaaggccaggacagtctttttcattgcaggcgggctcatcgactacggaagaatgccaagcacgctaacattcccgtcgttgattgtcaggacactctagctctaaagggggggcaggctctgaatgtaggagggggcttgctcccgatggctatggttcagtcaaaacatttagtgactgacaccctgctatcgggagcaagccccgtcccacagttgttctgtgttgtcgggcagaaatcaggtcgccatccgcacgccacccaaaccaccactcaactcatacgccaccagctcagcctggtgcgccgccaggatctccggcaacgaaccgcgcaggtattccacccaggtcttgatctttgcatccaggtattggcgcgaggggtagatggcgtacaggttcaattcctgggagcggtaggtcggcatcacccgcaccagtgtgccgttgcgcaacccttcgatggcggcatacaccggcaacaggccgacgcccatgccgctggtgattgcggttttcatcgcgtcggccgaattgaccaggaacggcgagctgttgatcgccacgctttcctggccttctgggccgttgaaggtccatttgtccagctggatcaccgggctgaccaggcgcaggcacgcatggttgagcaagtcctggggccgctgtgcgcagcccttggccttgacgtattccggtgaggcgcaggcgatgctgtaggtgatgcccaggcgctgggacacgaacccagagtccggcagttcgctggccagcacgatggacacgtcgtagccctcgtcgagcaggtccggcacgcggttggccagggtcaggtcgaaggtcacgtcgggatgggtgcggcggtagcgggcaatcgcgtcgatgacgaagtgctggccgatgccggtcatggtgtgcactttgagctgcccggcggggcgggcgtgggcatcgctggcttcggcttcggcctcttccacataggcgaggatctgctcgcagcgcagcaaatagcgtttgccggcctcggtcagcgcgatacgccgggtggtgcggttgagcaagcgggtttgcaggtgggcctcaaggttggagaccgcgcgcgagacattggccgtggtggtgtccagttgcacggcggcggcggtgaagctgccggcttcggccacgcaactgaaagcgcgcatattttgcaaagtgtccatggggtgttctcaagggagatagcaaattgtgacagaaagtaacgccgtccagtgatccctaccaacggattatcgcctgaacggtaacaaagattcacaggaatgccagcttatcgtcctccttgccgccgcctagaattgcgccacctcttgcgcaacaccctctcaggaattcgcttgccgtgccgcgtcacatcagcagagagctgaagactctcagtgtttgggccttatcgttagccatcagcggctgcatcggaaccggaggaatcgccccccaaggccacgccctcaacgccaatactttggccaccgacgaagccattcaagacgccgcccaggacgcccactggcccaccacccaatggtggcaagcctacggcgatccgcaactcaaccgctgggtcgaactcgccacccagaacagtcccagcctcgccatggcggccgcccgcgtgcggcaagcgcgggcgctggccggggtggcagagtcggcagagtcgttgcagatcaacagcgacaccaccctcaagcgtcacaattggccgaaagatcagttctacggccccggcgaactgagcggtgccaacacctgggacaacaattcatccctgggcctgagctacgcactcgacctgtgggggcgggaaagcaacaacaccgagcgcgccgtcgacctcgcccatatgagcgccgccgaagcgcgccaggcccagctcgaactgcagaacaacgtggtgcgcgcctatatccagctgtcgttgcactacgccaaccgcgatatcgtcgccgccaccctggcccagcaacagcagattctcgacctggcccacaaacgcctggccgccgggatcggcacgcacttcgacgtcagccaggccgaaagcccgctgccggaaacccatcgccagctggatgcccttgacgaagaaatcgccttgagccgtaaccagctggcggcgctggcgggcaaaggcccgggcgagggcgcgcagttgcaacgcccgtgcctggccctcgcggcacctttgaaactgccttcgagcctgccggcgcagttgctcggtcaacgcccggacgtggtcgccagccgctggcaggtggcggcccaggcccgtggcattgatgtggcccacgccggtttctaccccaacgtcgacctggtcggcagcctcggctacatggccaccggcggcggcatgctggaattcctggcggggaagaaattcaactacaacgttggcccggcgatcaccttgccaatttttgatggcggccgcctgcgcgcccaactgggtgaagccagtgccggttatgacatcgccgtcgcccagtacaaccagaccctggtcaacgcgctcaagggcgtcagcgaccagttgatccgccgcgagtccatggacaagcagtcggccttcgccgcgcagtcggtggcctcggcgcagaaaacctacgacatcgccatgatcgcctaccagcgtggcctcaccgattacctcaatgtgctcaacgcccagaccctgctgttccgtcagcaacaggtcgagcaacaggtgcaggcggcacgcctgagtgcccacgccgaactggtgaccgccctgggcggcggcctcggtgccggcaacgatgtgccccaggatgccaagacccttccgagcaagaccccggcggcgcttgccgtgtttgatcactgagtaggatttgatgactcccttgcctgcaccgctgcgctggctgcattcccttgagtggcgccgtggctttttcgactgggcacgcagcgacggcgtgacctgggtgtatatcttcaaggtgctggtcgctgcgtttctcacgctgtggctggccatgcgcctggagttgccgcaaccgcgcacggcgatgatcaccgtatttatcgtaatgcagccccaaagcggccaggtgttcgccaaaagtttctaccgcttcctcggcacgttggcggggtcggcggtgatggtgctactgattgccttgtttgcgcagaacaccgaactgttcctcggcgcgctggcgatctgggtgggcatttgtaccgccggcgccacacgtaaccgcaacttccgcgcctatggctttgtgctcgccggctacaccgcagcgatggtcggcctgccggccctggcccacccggacggcgcctttatggcggccgtgtggcgggtgctggaaatctccctggggattctgtgctcgacgctggtcagcgcggccatcctgccgcagacctccagcgcggccatgcgtaacgcgttgtaccagcgctttggcgtgttcgcgctgtttgtcaccgacggcctgcgtgggcgcagccagcgcgagcatttcgaggccagcaacgtacgctttatcgccgaagccgtgggcctggaaggcttgcgcagcgtcaccgtgtttgaagacccgcacatgcgtcggcgcaatgggcgactcagtcgcctcaacagcgaattcatgagcatcaccacgcgcttcaacgccctgcaccagttgcttgaacgcttgcgtgccgatgaggctgatcatgtggtcgcagcgatcaaacccggcctgcaagacctggccgaagtgctcgacagcttctccggtcgcgccctcaccagcccggatgccgcacgcctggtcaatcaactgagcgcctacaaggacggcctgcctgccaaggtgcgtagcctgcgggcgagcttccaggacgataaccctaccgaagccgagcaactggatttccatacggcctacgagttgttgtaccgcttcgtcgacgacctgcacaactacgcgcaaacccacgcgtccctggccgaccaccaccatgcgcgggaagactggcacgagtcctacacgccaaaaaccaactggttggcctgcaccgccgccggggtacgggcctcatttatccttgtcgtactgggcagttactgggtcgccaccgcctggcccagtggcgcgaccatgaccttgatcgcagcggccacggtgggcctctccgccgccacacccaaccccaagcgcatggcgttccagatggcctgcggcaccttgatcggcgccttggtcggctttgtcgaaatgttcttcgtgttccccaggatcgacggtttcccgttgctgtgcgtgatgctcgcaccggtgatcatcttcggggcctttctctcttcccgccccaggtacgccggtgtcggtgtggggctgttgattttcttcagcaccggctcggtgccggacaacctcacggtctacaacccctacacctttatcaacgactacatcgccatggtcatcggcatgctggtatgcgcggcggcaggggcgatcatcctgccgcccaacagccgctggctgtggcgccgcctggagcaggacctgcgtgagcaggtggtatatgcgatcagcgccaagctcaagggtctgacttcgagctttgaaagccgcacccgcgacctgctgcaccaggcctacggcctcgcggtcggccagccgcaggtgcagcgcgacttgctgcgctggatgttcgtcgtgctggaggtcggccacgcgatcatcgagttgcgcaaggagcaagcgatcctgccggtgcacccggcgtatgccgagtcccagccgtggcgccaggcaatccgtgtgatgggccgttcgctggtgcgcttgttcctgcaacccagcgccagcaacctggagcgcggcttgatcgccgtcgaccatgcgatcagccgcgtacaggccaccgatgaacctttcgccccgcacttcgatacctcggccctgcgccgggtgaagagctacctgcactttatccgcacttcgctgctcgacccgcaatcgccactggcggccctaaaaggagcctcgaatgccccgtgaaatcgcatttcatggcatctatatgccgaccatgaccctgatgttcctgatcgccgcggtgttggcctgggcgattgatcgcttcctggccgggttcgacctgtatcggtttttctggcacccggcgttgctgcgcctgagcctgttcgcttgcctgttcggcgccctggcgctgagcgtctaccgttgagaatgccccgatgaaaaagtttttcagcctgctcgcgaccttgctggttctggccttggcgatctggattggccgcacgttgtgggtgcactacatgcaaacgccatggacccgcgacggccgcgtacgcgccgacatcatcaacgtcgcggctgacgtgaccggcgaggtggtggacgtgccggtacgcgataaccagttggtgaaaaaaggcgacctgctgatgcagatcgaccccgagcactaccgcattgccgtcaagcaagctcaatcgctggtggcctcacgcaaggctacctgggagatgcgcaagctcaacgcccaccgccgcgccgacctcgacgccctggtgatctccagggaaaaccgcgacgacgccagtaatatcgctgactcggccctggccgattaccagcacgccctggcgcaactggaagccgccgaactcaacctgaaacgcacccgcgtgctggcggcggtggacggctacgtcaccaacctcaacgtgcatcgcggcgactatgcgcgtatcggcgaggcgaagatggctgtggtggatatgaattccttctgggtctacggcttctttgaagaaactaagttgccccacgtcaaagtcggggataaagccgatatgcaattgatgagcggcgagaccctcaggggccatgtggaaagcatctcccgcggtatctacgaccgtgacaaccctgagagccgcgagctgattgccgatgtgaaccccacgttcaactgggtgaggctggcccagcgcgtgccggtgcgcattcacattgatgaagtgcccgagggcgtgctgctggcggctggcatcacctgcaccgtgatcgtcaacccaacacaaaactaaaaactgtgggagattcaaatgtgggaggggcggtgcgacgattcgacttgcccccgatggcggtgggtcagtcacagatgtgcttactgacactccctcatcgggagcaagccccctcccacatttagacccgtgttatgccttgataaaggtctcatgcaagtgccgccaaagcagcgcaccactggcctgtttctcaaatactaccgtggcgcggcggtcggtctgggtgccgctgtcgtcaatctgatgctcgcgatacgtgaccgtcgcgccgcgtgcatggcggtcgatgccggtcatttcactcaaggtgattttcaaccccgggcgcatcccgcccaggcgcgtgaacaacgcattgaccccggccctgttgacccgcgtgccggtggcgggcgcgatcatgctgaactcgggtgagaagcgcgccagcaggttttgcagcgtgccctcaggcgcaacaccggcaaaccattgctcgatctcgacgtgggtctggatcacttcttcaaaaaaatcactgtagtcaatcatgcttgggctcgctggaagggtgaagcaggctgcgtaccctggacgcatccaggcgcagcactgcgaaaagcggcaacagggtcaaggctgccgccatcgtgaaggttatggcgaaggaatccaaggtcgacagcacggcactgagcacggcggcacctacgcaaaaacttacttggcggttgatattccacaaggcactggcctggcccatgcgctcggcggggatatccagaaaggccagggtctgtgcggtgctgctgcacaggctgccgcccaggcccatcaacacataggcggcaatgatcagggccggctcgttgagcaacaggatgccgccgcattgcagtgtcatgcccgccaccagcaagggtttcggaccacaacgattgaagagttgcttgctcaggtagatcgccatggccgaggccagggcccagggcaacatgagtgcgccggtctgggtagcgtcataccccaggccgcgtacatagaggatggcaatcaggctggtgccgataaataccccgggaatgcacaggtagaccagcatcgccacgcgcagcatcgggctggcggcctgtttgaaaatactgcccaggtccaggggcgggcgcgtgcttgtgggcacatcgggttttatccacaggagtgtcagcagcagggtgatcaaggccagtggcaggttggcgtagaaaatccagcgccaggacaggctgtcgacaatcaccccgcccaacgccggggacagcgccggcaccagcaatgccaccgacatgacccgcgccgtcaactggctgcgctcggccgctggaaagtgccggtaggccatggcttgccccaccggaatcaacaagccgccgccgagtccctgcaaagcgcgccagccgatcaacgcatcgatggaaccggcctggccgaccatcaccgaggctcctgcgaacagcagcagactggtagcgatcagtgtgcgctcgcccatgattgccgccagccatacactcaagggaataattaccgtcaacccgagcatgtaggcattgctgatccacgccagctgcgtgaccgaagcgtgcagctcgcgagcgatatccgggtaggcgacggtggcgacaaacatgttcaccaggtccagggcgaagcccagtaaaaagatccaggcgactttcgagcagtagttcatgaacgctatcctgcgaatgaagcgtgcagggtagggcgggcgtagcgtttgagatacgtcggtttggctgttagtttgtcaaaaatattttgacaacggaggacgtggcccatggtcagcctggaccgattcgacaccttcaaggccgtggtcgaggcgggctcgctcacggccgccgcggacctgctcggccagacgcgcgccgtggtcagcttcaacctcaagcgcctggaggcagaactgggcgtcaccctgctgacccgcaatacccgccagctggcgctcaccgatgccggcgaacgtttctacctgcgctgcacccgcatgcttgaagaggcccgtttggcggtggaagaagcccgctccgaacacgctcaactcaagggcaccttgcgtatcaccaccaccgtggaatatgccctggccgtggtcgctccggcggtagaagcctttcgccgcctgcacccggacctgaatattcacttatccacatcctccacccatgccgatctgatttccgagcgttttgacgtagcgattcgcctgggtcgcttgctggactccaatcaccgcgccgtgcagttgtcgacgtttgacgtgttcgccgtcgcggcgccagcgtttgcaggcgttaagaccttggatgagttggaacaggtgcccaggctgggccatggtcgcctgaccgaattgagcgtgaccgaccccggcggcaatgagcaccaataccgtgccggtcccgccgcgttagtggccgacagtgcggcggtgctccagacgtttgccgtgcgtggccatggtgtggcgattctgccgcaatggctggtgcaggatgatctggacgcaggcaggctggtgcgcgtgttggcggaccatcgctttgcgccgcaagggatctatgcgatgtatccggatacgcggcatttgccgctgaaagtgcgggcgtttattgattttatgaagggttggtatcagttggttagttgacggatgacatttacgaggatgggggcaaaaggcttcagccgattgtgcgcatcgggcagtcttaagtcttccagtagcatcttcagaagctcgccgtcttcggcttcaaggtcattgccttccattccgtagtcgaagagcagcgtatcaagaatggattttctggcgctgaacagcgtgcgattgttttcacggcagtcgccaaggttcagcacttggatggacgtgatcgccctggggctcaaacccgccacacggcctgatagataaaacttcagttcggtttcgcattcgtccatcaaggatgtcagtggcaatgtctgatgtgcatgggctttgccacactgtttgctgcggttgcagctggcgacgatatttgaataatcgagcgtccgatgggggcgggtctcccgggccgcaacgtgttcgttatgggcagtctcttgggtaattgcatggcagcaatacgcgcacaaaccatgctgctcttcgatacaggcttggcgaatactgtttctttcttcgtgggttaggtcgcagtagcgacctttcggattgtcgcgcatccatttcgtcaattctgctggttcatttccttttatgatcttacgcactgcgcaactccagcttgcggatcagaagggcggctttggtcagttcgatatggccagggggcaggtcagtggacagctcttcgaacagtgcattggcttctttcagctttttttcttgcagcaactccagcaagcgatccagtcgagactgaacttcactgttgcgtatatctgtgtccatgacgctgagcagtacctgattggcatcaaggccgtataggccggtgcgctcctccagttcgccatcgtcgaggacatagcacaggacgttcttggtatcgctgatcaccaatggggaatgggtcgtcaggatgaattggcagttggggaaggtttcagtgagttgctggattaggcggcgttgccattgagggtgcagatgaaggtcgacctcgtcgattaggatgacaccagtgccttcaagcggattcttcaatgagggattcatgagtgccaagcggcgagcaatgtcgccgacaagtgccatcagtgatttttccccttgagaaagttgagaaacactgagtgtattgcctagcttgtcgatagccatatgcaatctaggttttcgctggactctaaggttgctaaagtcaggcataaacttgctgacggcggtccgcacggcatttagctgaggatcacgtgatgctaggtgcatatttttcagctcagataccagtttttcatccgtactggagattttttccagctgttccattacggctgaggatatgccctgctcgttctcagtatcttctctgtcacggaaccattcaaaaaaccgtccgaaatctacgccaccatttagagcgttttcgtatccatcaaactgatcgaatggattttcggattttcggattgttagtggaacgtcaaggacagatctttcgacagggtagaaggccactaggggaagtgagccgctgccatcaatcaaccctagatgaacgcgatagagttcagccagctcagttaacttagtaagagagctatttacctttgctttatggccccgcaaggtgcgagcaagtgtccatgaataggtcgccgaggctgatgctgacgggtgagttataccgctgacttcagcctcgattgtcgcgaatcgctcaccattagtgaccacatcctcttggatgggactgccgccgccattgtcggtgcgaatgcggccaaccagccaacttaacgacgtggctatcgacttcaaaatcgtcgtcttccccgccccattgttccccacaaacaccgtcaccttcgacgcatgcttttcggtaggcgcaaaggcgacttccaagtcggcaaaacgaccgacgttattcagtcgaatttttctgatttccatcgcattacccttgtggggccagtcagtttcaagaggcaggcggcgattatggcactcatcccggattttggcaggtaggcttcacgcttgcttacaacacaccacccaacccaaaacgcttcttcaacaccttctccagcaaccccttgggcaacaacgccgccatcagcggcaacgcccggctgccattgcctgaacgcaacagacgcggtggctgcgctcgctgcacggccttgagcacatccgcggcaaattcactggccggggtgggtttatcctgggaggcttggctgcgtgcccgaatgccttcgcgcaacgaccaccagggtgacttttcgttgatcaacagttcggcctgagccccggcgtttttcgcgaagcgggtatcaatggcgccgggctgtacttccattacccgcacgtcaaaaggtgccaattccatgcgcagggcatcgctcaaggcatgtacagccgctttggacgcgcagtaggcgccggcgaacggtgtgaccagtactccggaaacactgccgatattcaccaccaagcctttattgcgacgcagggcggggaacagtgcctgggtcacgccgacgatggaaaatacattggtttggaactggcgttgcatcgcttcggtgccgccgtcgagcaacgggcccatggcgccgtagccggcgttgttgaccagtacatccagctcgcccaattgctcggccagacgttgcaaggcggcgctgtcgttgacgtccaactgcacggcattgaagcctgcagcagcgagggcggcgacgtcatcgggctggcgagcgctggcccacacgttgaagcctgcggctttgaacgcgtcggcgagggcgcggccgatgccgctggaacaaccggtgatcagtacgttgggcatggattcatcctttgtcagtccgagaaactgccttgcaggtgctcggcgcgaaattccagggtttgcgggcgatagccggggcgcagtggcggggtgggcaggcaatcgtcccaggtggcgccggcctgcaattcgccggggccacgatagcgtggcgcggcgtagacgttgtcggccaggttgacggtgtctcccggcgcataggccgcgacgcgccagcgcagttcggtcagcggtacgtcgttgccgttgttcagggtcagttttaaaggacggtcggccgggcattcctgcggggcgtaagtaatgcgtagttcaaggcgagccaattgcgcggcctcgcggttgtccagccagacgacccagacggcgatgaaacccaggccgacggcagcggccagcgataccggcagcgccttggccggatagcgcagcagcagaaccagccaggtgatgatcaggagaacgccgaagaacatggagaccacctcgaatagggaacgagcatcctaacttaagcgtaggtgtgaccgcgatcgggtacttgagcttacatttccagcggaaccactgcgccttgaacactcacacatctgacgccctacagggagtgtagcgacaacattcacacttccctatgaggctcattttatgttgggacctaccccgaattcgccccgtcttctttccgtgcaaagcgtcaacaccacagacgcatttgcagccaaattggtcagcaacgctgaaactgccaatgacgcggactcgcacaatcgcgtgcctatttcgccggttttaacctacgcacccgctggcacttctgttcccagttcgcccggcataccacctgtcagggtggagtatccgcagctagtacggcaattcaaggtcaccgatcaggaggcactcgtcacccaacatgcctttttaacccgcgacatgcagcgtttgcatggtgagcaaccgagtttcaatgatttcctgcgccagcaactaggccaaatggtcccggaccagccgtccctgaggctaaaagacctgacgttcaaacgctggatcacgcagagcgatggcacggtgaaaacgctgtcttcagagccactacgggacgccttgagcagaaaggtggtgagcctgttgaccgatcctgaccagaaggacgaggcagacagcgccgaacagttcggcatatttacccgtgcttcagacggctccgagagtgtcagcgtcaatgtgcagctcacgctggatacgattgcccggcgcattgtcacgcaatttgcgccgacccttcaggcattctagacaacacctcgcccgactttgcgagaccccaacgttctggagtctcctcagaatcagttgttggctctgcataagcaacaactgtcgaccctcgccgcgttgcgtgtgagtgatggaacactgagcgcggcgagcaagcgattgatcgacgccgcattgcagtaccccacgctggccgaacgggaagcggcctttcccaatgatgcacgcccgggtgtctacccgcttaccatggatgatggcactgagcgcggcgccttgatggcgggcagcttcctcatcaccagtactgacgggtccgaggcgacgcctcccacctgggcgaaaggccggaccctgcctctcaatgatgcaaacgggccggttgtgctgtacaccccaagtgaagggttcgaagagttcgctacacctgcccaggcacgccaggtacttgcgcagcgtcttgatgcggcgggccccaatgctgatctattgcggcaaacgctgccattggcgctgcaaaacaagaccgagccaccctctggcgatgatttgatgtggagcgtcgaacccttggcaggggatgtgctgggcgagggcatttcccggatgctcaagcgccaggaggaggaaatcaacgcgaacttttcccgcgcagcgacggacccgggagcatggaaggctttcgataatgccgctgattggtcgtacctgctcagtggtgacaatgctatgttggcgcgggatgaaaaactggctgataagctggcgcctgagtggctcaaaaatttgaccccggagcaagaaactttctttgattttctggagcactccgaggcaattagcacacgtgcgctggcatcgatgctggaaaaacttcctgctttgaacgtctttgcccgagaccggataaacgaagcaatcaaaaagctgtacccgagcgcgcaggtgaatgcggacaagttgatggtgcaggtgaaaaccaggtcgagtctgcagagtggcggacgaggcagtacccatacactcggcttcaacaacacaagtatgtcgctgacggatctggcactgaaaaaccccagcgaatttccagccattgagaggggccggttcactcaagtcacgtacacattgccgctgaccgacacccagggcaacccgatcctggatgctgaaggcaagcccgtaattctggataccgagcagctcaaagcgttggtcaacaccactgatgtggggggagggtatacccgattgcttaaagaacagttggccacggacacccaggagggtgctgcgggtgagctgcgcaaagcatggaaagccagcctgagtgacgcgctggataaagaagcttttctggcatcactcaaccccgatgcctacacgtcgccagcgatcctcgacacgagttccaaacggggcgcgcagtgggttgcggctgttcttgatcatccagatccggccgaccggcctcaggtcgatggaaaaaacattgtcgtcaatgcgcttgtccagcgtgggttgccggttcagggcgtcatggtgattggcaaccagacagacaaacagctggtgctgtacacgccggatgcgcccgacggtgtgtcctttcgcgaagtggccgatgaagaagctttgaatgccttgatggataaaaaggagtggaggctttacagcgcgagcaggacatcaccgatcgataaaaatgatgtggtcaaagctggcgaggccatcaggtcgtatgcgttcgatgcgacgaagaatccagtgcgcaccgtcggactgctcatcgacatgctcaagttgacgagtgctcgcatgacactcaagcccatcgatggcaacttccaggaggaactgtacaagcaaaaagtaaaatcgctcatcgaccatgctgaccatcaatccgtcagtagcgccgaggttgcgactcaatcgaaaatcaacaaggctctattcggtattgaagtggcgatgatctttgcagacttgttgcctgtgctcggcaaaggcgtgtcgatgggggtgcgcttaggtaaagcagccttgacgaccttgcgcgccaatgcccgaatcctgccacggctgatcaagaaaccggggctactgcgtggggtttattcggagttcagtgtggctgcctctggtatccccaacgttcgtgtcgcgccgttgcggccggtccccaagagcccattgacaagcagggcacctgctccagtgatcccgttacatacgtcaggtagtgtgcctgcgtcagcggccggcgcgagccaaaacctcaacctgagtgccattgctgtgtcggacgatgtcatcaaaggccggccgttgaggcccgacggcacctacaacgtcggcgacaattggtacgtgcgctttaccgacgatacccaggtcagcagggtgtatcagattgactcggccttccatgcgcgcgatgggcgagtcgcgatcatcgatcccggcatgccctcgaccgcgccaaaactctatcgggtacgggcgtttctgcagtcggacggtaatggtggatggcgatcgagccgattgccaggtggggctccacaacctacgacggtttcccagggtaccaaacgcccggcgagccagggcagttctacaaccggcgccggcacgagtagcgcgacaaatggcctaccggcctccaagcgacccagggtgcctgaaagtttcccgggcgaaaaagcgctgatggagccgccggtcaaaggtaaaaatgttttttatcactacaccggggccaagccgcatgccgcgataacggccgatcgaagtctttcgccttcaagttcagacttgagcggtcaacctcttcccggcaagcgaggcaggcattactttacggacttggcgccaggggatatgccgaccaagcagatttccgaaaccatcttcggaaagcgtaaacatggcaatgcgctggataaaatgtcgcactactatgaagtcaatacctcgggtttgaatgtcatacaaagcccaaataacccgcatattttttatgtggatataccgtttgaaattccgttgaagtaccggggcgggccaaacggtgagttagttgatcgtgtcatttcccatgggaaaacaccgcttaaattgtaagtacatggcggctgctttcacgtagagcgtggaagcaaaaagcccccacccaacccactgcggataggggacgcaatgggctgggtgagggcttcttgtacgactgttttattgcgcgatagttttcaccgacacgccacgttcaactggcgtcgagcgaccgtagatatcttcgaagcgctcgatatcgtcttcgcccaaatagctgcccgactgcacttcgatgatctccaacgggatcttgcccgggttgcgcaggcggtgcaccgaggcgatcgggatgtaggtggactggttctcgcagagcaggaacacgttctcgtcacaggtgacttcggcggtgccgctgactacgatccagtgttcggcacggtggtggtgcatctgcagggacaggcacgcgcccggcttgaccgagatgtgcttgacctggaagcgcccgcccatgtccaccgagtcgtaggagccccacggacgatagacttcgcagtggttctgggtttcgctgcggccttgctcgttgagggtgttgaccatctgcttgacgccctggaccttgtccttgtgggcaatcatcatcgcgtccttggtttccaccaccacgatgttgtcaaggccgatcaccgacaccagtttgccgttgccatgcaccatgcagttgcggctgtcctggatcaccacgtcgcctttgctgacgttaccgttggcgtctttgtcattgaccgcccacagcgaggcccagcaacccacgtcgctccagccggcgctcaatggcaccacgcaggcacgctgggttttttccattactgcgtagtcgatggaattgtccgggcagcaggcgaaggtggcgtcgtcgaaggtcacggtgtcgtgggtctgctcgctgcgctccagggtcagtacgcaggtgtcgtagatgtccggatcgtgctttttcagctcttcaaggaagcggctggcacggaacaggaacatgccgctgttccagaagtaaccaccgcttttgacgaactcgatggcgcgcttttcatcgggtttttccacgaactgctgcacgcggctcacaccttcgggcagcagcgagtcgttggtggacttgatgtagccgtaaccggtttccggacgggtcgccggtacgccgaacagcaccatctcgccacgctcggcggccacggtggccagggccagggcacgttgcagggctttctggtcgtcgatcacgtggtcggcgggcagcaccagcatcagttcgtcgcggccttcgttaaccagcatcatcgcggtcagggccacggccggtgcggtgttgcggccaaatggctccatcaggatgcgttggcattcgagcttacgtgcgctcagttgctcattgacgatgaagcggtggtctttgttgcagaccacgataggggagtccatgccttcgaacaccaggcgctccagggtttgctggaacagcgtgtgctcgccggtcagggccaggaactgcttggggaactgtttacgcgaaagcggccaaagacgtgagccgctaccaccggaaaggattactgggatcatgggtgtttctccttgaatcagtttgggtcagagctacgaaggtttgtcgtttcactcttgtttttgtctcgtatcctggccggccgcagccgaccaggaaaattcattcagcgggtcgacaccgggcgtttcacccagactggcgacaggctcgaaccggaaccggtgacgtacagcaccgctgcctcaccgcgctccagggcaaccggcttcacatcgccgaccttcttgtcgccgtcatacagcgccaggctcaccttcaccgggttgatctcgcgctcgccacggcccttggcggccaccgacttgaccacatcggtcttgccgtcggcagttttcagggtcagggccttgtcgctgaggttctgcacgcgtaccagggatttctgcttgttcttgaacggcggctcttcgatcaactgcggttggccgctgctgttattgaccagggtgtagtagtgatcggcagcgagtttgaccggcacggtctggctgccgaccttggcgctgtagtcaccgcccggcatgaagctgaagtcgctgctggccaatggcgccacgtcgctgaggttggtgctgccgacggtggcgctgacttcctggttgctggcgttgtagatgcgcacgaagctcgaaccctttggcgcggttgggccgtacagggcggcgtcaccaccggcgaaggctgacatcgatacgaagctcaagccggcagcgaaggccagggtcttggcgagacgacgcggagtagtagtgaaagtcatgtgagttacctctctttcagttttgcgcccggtcgggcgtctcggatttaggtgtgttgcttgccatgttctgttggcgcgaaccggcttgtttaagctgcgcaacccacgatgggtcggcatcaccgatttcgttatttacgggcagatagcgttcgggaaattcccagatcagcacctggggcgggttgttcttgaagtcgtcgcttttcaggtagctgagcatcggcaggatcgggccgtggccgtcttcggcgtagctgaccacgtcactgcccagggcttgcttgagggcgccgacgaagttccagttggggttggcgctgtagctggtgcccaccagtgccactggggtttcgctgtcgctgaacagcgcgtcgtcgcctttggtttcggccaggtgcgtgacacgtttttccagcggctctttaggcggcatcaggttttcgaacagcgggtccaggggcaggaacaagcgcaggtcgcctttgtgtggctcgatcttttcggcctcggtgacaaaacgctgcggctcgccgctcagcggggtcttgtcggcaatggttttcgccagttgcttggcggcgatttccgcgccatccggggtccagtgggtgtcggtgcgcaggaatacctgcttgccgcccagcttggcctgttgcagcggcccaagcaggtcgggggccgggatgttgtcggcggcgacccgggcgtggaagtcctggtacaggttggcgtgaatgctcgccggtttcacctcacccaggtgttccgggtacaggcgcaccttggccggcacgatcgccattaccaattgaatgccctgggccttgagcttctggcgcacgccttcgacaagggcgtagttgccctccaggttctggtcttcattgacggcggggttgaactcctcgtcgctgtacagccagtgatcgcggcccagcactaccccagggcggccttcattgaacagcttgtagtccagcgctgcccacaggttggtgccgatgcgcttgatcgggaactcgtcgtcgtaatgggtctcgacggctttggtccagcgaccgttgagcacggtcgcatcggcgttggtgctgaagcccaggaaactgcgcagcgaccaggcgcccagggccagcaacagcaccatgaacaggctgatatagaggacgcgtaatgaacgggtcatggtcggctccctcagaattggaagtaaaggaacggcgagaaactctgcgccgacagtttcaggatcgacgctacgaacagcagcagcaccgcggcgcgcatggcgtagcgtggccagtcagcggtccagtaggccggttgcacggcagcgtcacggcccacgctgaaaccaggctcgtggatgctgccggggttgtcgccaggcaccgccttgatcaggctcggatcggccggcttggttttctgggccgggcgattggtgtagaagtcgcgcaggccgaagaacgccagggttgcgtaggccaccaccagggtcgccacttgcagcccggtgaggttggcacggttgagttccgacagcgaccactcgccaaagctgaacatcgcaccgtacatacgcccggcgacgtgcaggttttcagcacggaagatcacccagcccatcaccaccagcaggaaggtgaaggcccagcgcagcacattgaagctgcgcggcgcggtgttcaggccgatggctttttcaattgccagccacatgccgtgccaggcgccccacacgatgtaggtgatgttggcaccgtgccataggccaccgagcagcatggtcaggaacaggttgcggtaggtggtcagcgtgcctttgcggttgccgcccagggtgatgtacaggtaatcacgcagccaggtagagaggctgatgtgccagcgccgccagaactcggtgatcgactggctgatgtacggctgtttgaagttttccatgaagcgaaaacccatcatcaagcccaggccgatggccatgtcgctgtagccggagaagtcgaagtacagctgcgcggtgtaggccagtgcacccagccaggcgtcgccggtggtggggttttgcaaggcgaagcaatggtcggccaccaccgccagggtgtcggcaataaagactttcttgatgaaaccctgcatgaaccgcgtgcagccctcggagaacttgtcgagggtgtgggtgcggttgttgaactggtcggccaggtcacggaaacgcaacaccgggccggcaatcaagtgcgggaagatcgccacgaacgccgcgaagtcgatcaggttgcgggtcgccggggtgtcgccacggtacacgtcgatgatgtagctgatggactcgaagatgtagaacgagatcccgatcggcaacagcacgtgggtgaggatgaaaggctccaggcccgccgacttcatcatcacgttgatgctgtcgacgccgaagttggcgtacttgaaatagccgaggatgcacaggtcgactgccacgccgagcagcaaccagcgctgcgccagcttggtacgcacgccggcggcaccgaccttgaggccgatccagtagttccacagcgtgacggcggcgaacagcgccaggaagtccactcgccaccaggcgtagaacacgtagctggcaatcagcagcagcagattgcgatagcgttgcccgctcaagtagtacaagccgagaaagatcggcaagaacagaaacaggaacacattggacgagaaaaccatcccgatctctccatgtttaaccaacagtcaagggccagagcccccccaaacccccccacgatttcgggggaggttgtattgcatttctactgacgaaaccggcttcaaatgtgggagggggcttgctcccgatagcggtgtgtcattgagcacagatggcgactgttacaccgccatcgggagcaagccccctcccacattttttaccgcgtttgctcaggaaccttttttgcctttttcgtgcgccgggtcgtagaccttggtcaggtcgccacccaggcggaatgtcttgaacggctgcatctcatgcttgcgctcgatcacatccggcgcgcaggtgtagagcgtgcagaagggctcaagccaggcaaatttcatgtcttccttgaggtccttcatgtcctgctctttgccgttcttctgctcgaagatctccgggtctttcaccccggccagcaccttgtcgcccaggcgtttgagcgcgccgttgttttcctggcgcaggtccacgccgttgaccagggcaaaactggcgatcatcgacagcggcggcagggcgtagttgtgatacgacagggcgcgctgttggcgcttcaactcgttcggcaaaaagccttggtcatcgacctggttggcgccgaccttgtattccttcaccgcccaatcaaacaggtcgcggcggttagtggcgatggaagtcgccatcaccgaccaggcggcccagtaggagtggttgttggttttttccagcggcaggttgtcccagtcgcttaccacctggtcggccagcttgttgaaccaggcttcgatctgttgggattcctgcgggtgcttggccagcggctgcgactcggagaatttcaggcgtacataggctgaagccatgctgcccagtgcccatttgcgcatggatttgccggtgtggttgaagtccttggacatcagcgcgtcggccttggcccacgacaccagccagttcagcgtgcattcgagctgctgggggcggccgtcacgcatgaactgcatcacgcgcttactggtgtctttttccagcttggtgatgtcggcggtgctgtcgcgaaaggccttttcggactgcacattcagcgtggagcgcgccttgtccgaaccttcgtacttgctgcgaaattgcagcgaaccggtgtacggcgctggcatggcgtcgcagtcattcttgaagtcgccggtcttgaacgcttcgatcggtgcgaaatagccctgaggcggacgcagtggcgcggcggcgttggcggccccggcgaagatcgccaggcccagcaacgatggaatcaataacttttgcataagtaacctcattgcccggttgaagcggtttgttgaccgccggctgggaatacgttgcgtgtgcaaattttcgcttcgaccttctgcgcggcagcaccctgttccgggccctgcacttccacggccagcaagttctgcgaggcccagtcttcatcggtgcgcagttcaaaggcgaaacgcccgtctgtatcggatgtttcgggtttctcgatcttgatgtcctcgtggcgaccgttcatataccagagggtggcttgcaaggttttcaccgacggatcggcgaagcggatatcgacctggtgattggcgttgcgcaggtccttgttggcactgttgaccatcagctcgttcttgccgggcttgagggtggtgctggcggacatctgcgcggtcttgccttcgcacccgttgtccagcagcgccatcatctggcgatagatggtttcctggtcgaggcggtacagcggcgagaattcccagatcaggatcttcggcggagtcttctggaattcgtcgctgcccaggtactggatcatcgacccttccaggccaccgccggggaaggcgacgttaaggatgtcggcgccgatttcctcctggaggaagccggcgaaattgtagttcttgccgctgtggctggtgcccaccagggtaatctgcgggttgcccgaatcgctgaacaggtcgccgtcaccggcttcgcccttgggctcggtggtgaactggtccatgtactggatcgcatagctggtgccgcacagttgcccggccatgttgtgcagggtgccggtcttgcccatgcggcccgagcgcttggtctcgaattcgcgcttgggaatttcggcgtactcaggcatttgcttgaccttggccgcgacgattttcgccgtgcgctgggctccgtacggggtccagtgctggtcaccgcggaagtagaaatcgtgggccggcaattcgtctggcaattgctcgttggtcagtggcgaaaggtccggcactacgtagcccatcttggcgaaacggccaagcatggtcttgtagttggtcagggccttgtcgaagtcgaacttggctttctcttctgggttgagcttgttgcggttcaccaggccacgggtcggctggtagaccaccaccagttccacgcccttggccttgaacgcatcgtgcaactgctgcatgcgtttgtagcctgccggtgtggtgtcgaattcggtgcgcaggtcttcctgggtacgaaacagccagtcgccctgggcttgtaccagagtggtgaagttctgctggtagcgcgtggtgtagttcttcgcgtcatgggcggccgggcacaggctgcagcatggctcggcggtgaaggtcggcgccttgacttcgtcggcgcgcacgccctggctggccgcaagcaggccgagggtcagacccgagaggctcagcagtttgatcatgtgtgggtgcataagggtcatcctcagtcctgcatttcggtctggcgttcgacagggtcgatcagcacggctttctgctggcgcaccagcaagtcgagaatttcttcctggcgctcgccaagaatgccgttgaagctgatgccactggatttggtcggcgccagcatcgacacgcggtacagctcgacactcagcggcgaatcgatggacagcggcccgctgccgttgcccgccagttcaccacccaccacgatcagcgagaccttggcgtcgaatgggtcgagggcaatgtcgcggtcggtgtcggtcaagtccttgatgtggccgtagagccccgtcaggccgttggccatcgaggtgttttcgtagagcttgatattcacgctgttacgcacacgaatgccgtggcgacgattggcgatgaccttgttgccccacagcaggttgtcgccgctctcatagagggtgatgccgtcggtgtggttgcggtagatctcgttgtcggcgatcaggttgttcacgctgttacggtcgatcaccaggcctgagagcttgttgtcgtagctgcggttgtttaagatgaagctgtcgttcacttcccgggaaatgatgatgccgtgcttcttcttggtgccgtacaccgtgttgtcggcgatgatcaggccgtgggaacggtcatgggggtcaatgccgtagacgatgttgtctttgtaggtattgcccttgatcacgaagcccgtggtctcgtagcagtagaagccgtaccacatgtccgagaactcggagtcgatgatccagccggtcggctcaggacgcttgagcaccttggccatgttcggcgtgtactgggaaatactcaccccgtaggacttactgttggcgtagccgaagctggccatcttggtcttggagatataggtctcggtaccgccccaggccagcaggaacgggcggaattccttggccgacttgaacagcgccgggccgttggctttttcatcccaaccggtgatcttggtatcgcgcacaaacagctggccgtcgttgatcaaaaacgagccggcttgctgggacaggcgcaattcctgggtgtttttgtcgatatcgaggatgcccttgcgcccgaccacgatcggcagcttggccaaaaagacacccggcgacgtttcgctgaagtactgcttgggcaccttgcccagcaggtccttgaggttcatgtagccatcgtcgacaaagatcgcctggggaatgccgtgctggcgcactacccattcggccatcttgttatcgccaccgataaagtccttgagcgcgtcttcctgcatcatgcggcgcacgctgatcttgcccggcttggtcttgacgatcttcttttccatggctgcggcggtgtagcccgacaggtccggcagggcaggcttggccatttccagcggcgcggtgggcgggctggaaatggtgtaggtcttggcctgttgcagttccttggcgatgatcggcgccttggccgtcgtatcggcgaacgctgtggcgctggccaacagcattgccgcgacgagtaggctttgagcattcatggcgcaggctcccatcagaatttccagaccacgtcgacaaacgcgcggtgcatgtaggagtcgacctggctgccataggcgtcgcccggcttgaacacgccggcacgcaagcgcaccagggccgacggctcgtcgatcgactggctcagcgcggcgggcagcaagcctttcttgaagtacttggtgaccaccaggtccatctcctggccgaggtctttcttaccgtcttccagaggcagggacgtgctggagaggatcgcgccggtgacgtcatcggtgttgttctgcactgcatcgataccgttgctgcccaccggcttgttgccgtccacgcgccagaacttgtggtacaccaggctggcgtcgtagtcctcgcgcagctgccaggaaccgaacaggctcatggactgcatgttgttcatctcgccgcgatacgcttcgccgaagcggtgcacgcgggattgggtgccggtccagttcgaacggttgctttgcaggccgttctgctcgtactcggcactggcgcgggagtaggccgcgcccacttgccattgcgggtccagacgcagacgcacgccgaggtcggtggcccagccactcacgttatcgctgcgcttggcattggtcggacgagtgccgtcggcattcaaggcatttacggtgtcgcggtcgccgcgcatgccggtgatgctggcccagtagttgacggtgttggtattgcgccagttgtaggcgtcgctgttggcttcgatgccgagccaggtcaggtcgccgttctcgcgtttgtccaacgggtccgtggccacgcctggttcggcgtagtcgagcttgccgtcgtcatgggtgtggtgaccgcgaaggccgatccactggcccggcgtccactggtaggcggcgtcggcgtagaagtgctggcggtccttgtccttgggcgagagttccttgaggtcggtgcggtactcgctgaaacgttcggcggcgccgacattggccttgagcaaggtggtgtcgaaggtccagttcagcgcttcgatgttggtgtcgcgccattggccgtcgtcattgcgcaggcgctggcgaccgaacttgaggatctcgccggggtagggcgtgaagccgctgtagccaacccagaactcgcgcagggccaggtagtttttcttggccttgcggtcgtcgttgctcgactgttcggtggtgtcatcggccgactgttgcaaggtgtcggtctcgatgatgtcgctggagacgacggcctggcccatggcgtaggcactccacgcgccgctttcgccgtagatccacgggcgcaggtcgaggccgatgccgttgacgtcgccgcctttctgggtgccgaggtcgcggtcatcttcggactgtgcagtggctttgacctccaggccgaagttcttggcttcggtcagcgcggccagggtcgggcacgaccacagcagggcgaaggtcaggccgatgccggccttgacgaatgggttgagcttcatagggattcctcgccgtcttcttcttgcagggcgtgcagttgcagcgtgctttgggccagggtgccgcgggcggccagttcctgttgcaccaggcgttggccttcggcgcgttgctcaggggtcaatggcgcctcgagctgggtagccaggtcattggcctctggcgtgttctgggccttggccagttggctgaagacataggcgttcaatgggtcgggcttggtgcccttgccttgggaaaacagttgggcgatggcgaagtcggcgctgttctggccgttgcgcgcagcggtcagcaggtggtccagggccttttgcgggtagaccttgcccaggtagccacggcggtagatctggccgaggtagtaatcggcggccacttcacggcccacggctttttcgaagtgggcttcggcggccttggcgtcggccggcacccatttgccttcgtagtagagcttgcccagcagcaattcggcgcgcggctggtcggctgcgcggccgttgtcgaggtacttcatcatctggtcgacgtcgcccatttcggggaagtcgtagagcagttgcgccaggctgacccaggaggccgggtaggcaggggcgattttttcaagcaaagcctgggcggttttttcgtccggcgtgccgaggctggcatcaccgagtacgcgggccacgctgtcgacgcgctgggcggtgacgctgccacggctgtagcctgcttccatctgcttgagcagctcagcctgtttttccggctcggcttttttctggtagaccgtggccagctcgacgtagcagatatcggtggtgttcaacgcggccttgcagatgcgctcgacgtcatccagatgctggtcgtaagtgtcctgggtgcgatacagcaacacctgggccaggccggcttccgggtaaccggcggcttgccatttgctgatctgctgctgggcattcacgttgggaaagctgtgcgggtattgcaggtacagcatcgccagcgggatcagggtgttgccttcgccattggcgaaggcttttttcagcaggctttcggcttcatggtgctcagcttcagtggcaccgggcttggccaccagcaggcggccaaggcgcgcctgggcgcggggcgaagtgtccgccgccgcacggtaagtggcttcggcctgcttgatttgcgccggatcgcgggtgccaacctggatatcggccaggcccacctgggcctcgctgtagcccaggtctgccagttgctggtaattctgctgcgcggtgacggtatcgccgcgcttgagggcttcgttggccaggcgctggtcgggcaggccggcgcaaccggccaggctcaccgcaacagccagcaacgccaccgaacccatgtgggaggtggcttgcccccgatgcaggcgactcggcccatcaggcaaaccgcgctgatcccatcgcgagcaagcccgctcccacagagattgtgttgttcttgaaatagggttcacaggcatgtcctcgcttacagaccgtgagccatggctttatcgatcagccagttcagggacgggccgcggtcactggtgacttccaccgggcggccggcgtaggtgctgtccagcggtgcatccggcttgatctgcacgcggatgtcggaggacaggtcggcgctgttcaggctggtgctgctgacgatggtgccggtgcgaacctgttcttcatcggcgacctggaagctcaccggcgtacctggacgcacatcgccaaactggcggtaggtgaagcgggcttcgacgttagcctggctgccacgcggcaccagttggaagatcacatcgcccttgctggcgtactggccgtcggcgaccagttgctgggcgaccacgcaatcgcatggcgaggtgagggtgccggtcatttgcttgccgaacagctcttcaaccttggccggttgcagttggtcttcgtccaggtggcccttgagcacgtcgagcatactggtgctgaacgtcgccagtggcgcgcccttggccgctaccgagtcacctttgagcaggctctgcacggtgccgtcacgcggcatggttacgttcatgcccggtacgctgacgaggccggcctgggcgtggctgacgaagtacatgccgtacagcgatttgaagacaaaaccgaacgcggccaggcccaccaggaaaatcgccaggctgaacgtcacggcacgcaggcgaccgaatgcggtcatgccgctgccgccgtccttgaccttgcgtgccttggtgaagttgtcgcgttgcagggtcgccagcacgtcgcccatggtcacgatgtcgccggacaggtgcgaggtgatcaggtggcgcagggtggaaatgtcctgggcatcgaggttctggaactggcagccggtgcggccggtctggcggtcgtaggagcgaatctgcagctccacatccatggccaggccgaggttatcgatcacgaactgcaggcggcccttgtgcacctggccgacggtgagcggctgggtcgcggtgaaggccaggccgccggcggacaggtcgatgacccgcgcttcggtcggcgtgcggtcgctgttgaagaagcgcagcttggccgggattttgacccgtgcatgctggcgctgggcttcggattcgtggacaacgttggcgtttacttggctgttcataatgttctagttcctagttaattcaggcttggcagggtcagaccatcatcagcaacacggcaacgaagatgctgccggcggagaaggtcatggtccgagacgaccaggtgttgaaccaacgttgaaagctggccaaatcgcgggtcagtttggtgtcctggcgggtccaggactgttgatcaaggcggaagaacacgtagatcttcaccaacgcgcccatgatctggttgtaatagagaatcatcgggtaggccgggccgatcttgtggcccgagcacgacagcagcagggtcaggatcaggcgggtaagaccgatccacagcaggtagaccaggatgaacgcgccgccgtacttgaaggtggcaatcatcgccacggtcaggcctagcagggaggtccacatcgacacgcgctgatcgaacagcactacgctggtgaacaggccgaggcgacgtacacccaggccgagggcgcgggagttctggcgcaggttgttgccataccagcggaacatcagcttgcggctggccttgatgaagcttttttccggcggatgttccacggtgttgatcgcggcgtccggcacgtagaaggtgtcgtagcccaggcgcatcaggctgaaccagctggacttgtcatcaccggtcaggaacttgaagcgccccaggcgccagtgttgcagcgagtcgctttccacgtcggcgataaagcccgggtcggtgaccacgctggcacggaacaccgacatgcgcccggtcatggtcagtacgcgcttggacaaggccatggagcacatgttgatgtggcgctgggcgaaacgcagcttgtgccactcgctcatgatatagccgccgcgcacttcgcagaattcgttggtggtcaggccgccgacattaccgaacagttggaaccacggcacggtcttgcgtaccacaccttcggccagcaccgtgtcgccatcgattacggctaccacagcgcggtcatccggcaggtggcgagagatagcacggaaaccaaaggccaggccatcacgcttgccggtaccggcgatgcgcacgaagtcgagcttgacgtgggccggcgggttcatcttttcccagaggctcttgaccagcagctcatcggacatttccaccagcgagcagaccacggtagtagggaagccgcattcgatggcttcacggatcaccgagctgtagacctgggcggtggtcagcgcgtcgatgcggaaactggtgaccatcaggaacacatgggacgggtcggcggccttgcccagcttgcgcactttgcggcgcaggtgcggatagaccacgtacaggaacagcatgccgcgaaagaaatgcgtcgctcccatggagtagcgccagatacccacggcaccaatcaggaaaataaaattcttcgattgcgagtcgaaggtgctcgccggcaacagcagggcgagacccatcagcaggctgaggaagaacaaccagccggccgcttgcagaaatatatgttttaacttggacataagcgtcatccgcagggggaggaggcttcaggctgcaagcgctggggataaagacacttgcagcctgaaacttgccgttgctgttaccagcaaataccttcggtacggccgctcacgctggtggccttggacatgaagcccaccagatcgaccacttgcttgccatgcggggcgttctgcgccagggcacggaacttctcatcacggttgcccaggatgatcacgtcggagttgttgatcacgtcgtcgaagttcgagttgagcagggacgacacgtgggggatcttgccttcgatgtagtccttgtttgcaccgtgcacacgggcgtactcgacgttgctgtcgtagatgctcaggtcgtagcccttgccgatcagcatttccgccagttccaccagtgggctttcacgcaggtcgtcggtaccggccttgaagctcaggcccagcagcgcaactttgcgtttgtcgtggctggaaacgatatcgaaggcattctgtacctgggactcgttgctgcgcatcagcgagttaagcaacggcgcttccacgtccagggagccggcgcggtaggtcagggcacgcacgtcttttggcaggcacgaaccgccgaaggcgaagcctggacgcatgtagtactgggacaggttgagggttttgtcctggcacaccacttccattacttcgcgaccatcgacgccgacggccttggcgatgttgccgatctcgttggcgaaggtgaccttggtggcgtgccacacgttgcaggtgtacttgatcatctcggcaacggcgatgtccttgcggatgatcggcgcgtcgagttcttcgtacagcgactgcaggacatcgccggaggctttgtcgaactcgccgatgacggtcatcggtggcaggtcgtagtcagcgatggcggtggattcacgcaggaattccgggttgaccgcgacaccgaagtcgacgccggctttcttgccggagcaatcttcgaggatcgggatcaccacgttggccacggtgccaggcaatacggtgctgcgcaccacgatggtgtggcgggtggtcttgtcacgcagcacaaaaccgatctcgcggcataccgattcgatgtagttgagctccaggtcgccgtttttcttgcttggcgtaccgacgcagatcatcgacaagtcggtgtcacgaatggcttcggcgaagttggtggtaccgcgcagccggccagtctcgatgccctggctcaacagttcgcccagacccggttcaacgattggcgatttacccgcgttgatcaggtcgatcttttccttggagatgtctacgccgaccacttcgtggccacgggcagacaggcaaccggcacagaccgcgccaacgtaacccaaaccaaatatgctgatacgcatcgcatttacctctttgtcactgaagacgttcttaatcatgccaatagatggccggagttcatgtttgcaagcgtcactgatgccgcgaaagttaggcgaatagacgccgacttgccgcgtgcaggcatgttgaatagtgagtgactaactattgcactcaagttgtgcgcaacttggcctttttattggggcttgccctgaaatgcagccgggcttccttggtggagggctccggcgccagtgccgcagggctttgatacaggcttaaagccttttgatatcaatgccttgggttttcaccactggctcatttaggtcagcgctgccttggccttcagggttggcaataagtgcttatcgctaccctcaactcaaacagttgatgttatgaccatagagtcaaagtgttttatgacaacttgactacttccgttggtcgctgtgtaagtcatctcttacgtaaacagagaatttcgttaccggtggtatgagcggcgcttcagggtgaagttcctggccgctcatcctgtttctggaaatttcttgaaatattagaaaagatggcactggtactatagtgatagcacttgctatttaggccagtagttgtagggagttggagagggaggatagttttgtgccactactgtttaaaaaaagtggtgccactacgaaaaaaactgacgagtgtcgagtgaagaaatcgttagggttgtatctggatgtttttctggcgccaaataaatgacgatttatggtttggaatacaaacaaaatgtgggagggggcttgctcccgatagcggtgcgtcagtcactgaagtgttgactgaattaccgctatcgggagcaagccccctcccacatttgattcgcagtgtctgtgcagccttattccagtgcgtgatcgcgcaagaacaccaggttatccggcttggactgctccgcattgaagcgatagccctgtacatcgaactgcttgagcttggccgggtcgttgatgcgctcttcgatcacaaagcggctcatcatgccccgggccttcttcgcgtagaagctgatgatcttgtactggccgttcttcaggtccttgaactcggtgttgatgacccgcgcattcagggccgggcgcttgaccgccgagaagtactcgttggaggccaggttgagcagcacgtcatcgccctgtgcggccaatgcttcgttcagccattcgctgatgcgcgtgctccagaaggcgtagaggtccttgccacgggcgttggccagcttggtgcccatctccaggcggtagggcatcatcaggtccagggggcgcagcaggccgtagaggcccgagagcatgcgcaggtgatcctgggcgtagctgaaatcggcatcgctgaaggtctcggcgttcaggccggtgtacacatcgcccttgaatgccagcagcgcctgcttggcattggccggggtgaaggcgggcgtccagctgccgaagcgggcggcgttgaggccaccgatcttgtcggagacgtgcatcaactcgctgatttgcgccgggctcagcttgcgcagttgttcgatcagttcctgggagtggtccaggtattgcggctgggtgaagcgcgcagtgaccggcttggactcgaagtcgagggttttggcgggggaaatcaccatcagcatgaagttggctcctggaatcgtggcgtgattctagggggttgaagcgttcgactccacctatcaagctgataggccctgttttgtgtaggagcgagcttgctcgcgaaaatcttccaggcaccgtgtttattcagtctgccagcgtgatcgttgacgactttcgcgagcaagctcgctcctacacaataagggtgaaccagtccgctatgatgggcggtaactctggaaaggaagaccccgtgtgcgattagcgcttttattgtcggcttgtttgctgtgcgtcaccgcccaagccgcgccggttgacgtagccagcctcgaccgtggtacctggccggaaaaactcagcagcccggcgctgttcgatgtggcttcgcgtgcggaaattctgatgttcgcccacggcctgctcgccagcgaagccctggacgacgccgcgctaaagcagcggttggggttgaagatcatcaatctagcggccatcgacgacctgcgtcgccagctctggcaacggctgttggagaactacagcttcgcccaaaagagctgcgaagaagatgcttcgttctgctacctggtggaaagcatggacgacctgcgcgagcaggccggcaagttcgaggtcagtgacaactctttctatataggctgggccgcccctagccggcactttcacgagcgctatctcgacgagctgctgcgcaaggccgcgctgttcccgcagatcagcagtgaagtggcgcgctttggtgatcatgagcgcaatggcgacgagctcaatgaccgcatgttcctgctgaccttcgatggcggcccggcactggttggcggcaataccgactggctcaccgactacctgcgcaaacagaagatgaacgccacgttctttgccctcggcagcagcttgcaaacccgtgtagagcgcagctctgctgccgatgtgcaggcgctgtaccaggggcagtgcgtaggtatccagggttgggagtaccgttcccacagccattggatcgactggcaaagctccatcacccgcagtgccgcgctggtgcagaacctgatgccggagaactatctgccgctgttccgcccaccctatgggcagcgccgcgcggacagccagggtttcttccagcaacagggtttgcaggtggcgttgtgggacatcgattcccaggacgagccgggcaagctcaaggccgatgagtcggcgcaacgggtgctgacgctgatgctgctgtggcgcaaaggtgtgattgcctttcatgacacccaggacaaggcgcgggtggcaataccaatggtgttgcaggcaacggcgcagagtggcttgggttggcaggagtgccgcgaggcgtttcgctgagaatgcccggccctgttggggatgagggtttttaggggtgatttgctgcgacatttcgatgcaggcggacttccgactttaacggggcagctggcactcggctagtgctattcgtcatcctgaaaaataaacttcaaaaaagcgtcaaagtgctttttcctgtcatgggttttgcggtattacgaagtcagaccgccgaaccctgcaacacaggtggcgtcttccaagactcctcatgtgggcactgcacttgacgtcactcaggtgtggtcggtggtcgaatcgaggcgcagcaccgcccaggtattgcgtcgactggctcccacaaaggtgaccgagtatggatgatcatggacgtaccccttcttccgaccagccaatcctttacgtgcttgataccaacgtattgatccacgatccaaacgcactgcttaacttcgaagaacatcacgtcgccatcccgatgatcgtgcttgaggagctcgacaaactcaaaagcggccaccacagcgttgccgccgaatgccgccaggccatccgcctgatcgacaagacgttgggtgaagcttcgcccgaggatgttgaggtcggcgtgccgatccagcgtggcaagagcgggcccaagggcttgctgtcgatcctgatgagcaagcgcagcgagcccaatagcctgctgccggaaaacctcaacgacaacaagatcatcaaccagttgatcgacctgcacgcgcgcgacaaggacctgcgcgtagtgctggtgaccaaagacatcaatatgcgcctcaaggcacgagcgtgtgggatcgctgccgaggactacagcaccgaccagctggtcgacgacgtgtcgatgctctcccgtggttatcacatgatgaccggctcgttctgggatcgtgtcagcaaggtcgagacccgccaggaccacggccgtacctggcaccaggtgcagctgatcgacaacctgccggccgtgcatatcaatgagttcatcgtcgacgaacaaggcttcgtgggctggatcaaagagatccaggtcgacaagctgctgatcctcgacctgcatcaggaacccctgttgcaccaggaagcctggggcctgaaaccgcgtgatatctaccagagcctggcgctgtacgcgctgctcgacccggatatccacctggtcaatctgaccggtgccgcaggttcgggcaaaaccatcctcgccctggctgccgccatcgagcaaaccatggtgaccaagcgctaccgccgcatcatcgccacccgcagcgtgcagggcttggaccaggaaatcggcttcctgcctggcaccgaggcggaaaaaatggagccgtggctaggggcgatcaccgacaacctcgaagccttgcacatggatgacgaaaacacccatggcagcgtcgactacatcctcagcaaagtgccgttgcagttcaaatccctcaactacatccgcgggcgcagcttccagcagagcctgatcctgatcgatgaatgccagaaccttaccccgcaccagatgaaaaccatcatcacccgtgccggcgccggttccaaagtggtgtgcctgggcaatctggcacagatcgacaccccttacctgtccgcgaccagctccgggctgacctacctgacggaacgcttcaaagacttccccaacggcgtgcatatcgcgctgcaaggggtgcctcgttcgatcctggctgaatacgccgaatcccacctgtaaccaacaagtggctaaatgccacgaaccaccccggatttttcacgaaatccggggtttttgttgttggcgacatttgtctgcgataacgcgccctgggtgcttgtggtctttgtaattattttgttacattttttctcgcggtaaaaacaataaaaacactccacaacccgtcggagcgccacctccttgattcgacgaaccttttgaagacctatctagggttttcaccgtgaccctgcctattacaaaagcccgaaacaccgctcattgacgacgcacatatccaaagggaaaggaaaatggacgtagcaggtaatggcttcactgtgtcgcaacgcaagcactctactcgtttcaagcagatgcccctgacacccatcgcactcggcctggccctatggctggggcagggctcgatggcctgggccgatgacaatccctatacgtcacaagtattggaatcggcgttcaggaaagccgtcgcgtcattcggccccaacaccgacgtgtacaagaacctgcggtttgcctacgcggatatcgtcgacctggcggccaaggacttcgctgcccagtccggaaagttcgactcggccctcaagcagaactacgaactacagcctgaaaacctcaccatcggcgccatgctcggcgatacccggcgaccgctggactacacctcgcgcctggattactaccgcagtcggctgttcagcaacaatggtcgctacaccaccaatattctcgatttttccaaggccatcatcgccaacctgccggccgccaagccctatacctacgtagagccgggcgtgagcagcaacctcaacgcgcaactgaacgccgggcaatcctgggctggcgcaacccgtgactggagcgccaacgcgcaaacctggaagaccccggaagcccaggtcaactctggcctggaccgcaccaacgcgtactatgcctatgccctgggcatcaccggcaagggtgtgaatgtcggcgtgctggactcgggcgttctcacccggcacttcgaattccagggcaagaatgcccagggccaggaccgcgtgcaggcggtgacctccaccggcgagtactacgccacccatccgcgctaccgtcttgaagtgcccagcggcgagttcaagcagggtgagcatttcagcattcccggggaatacgacccggcgttcaacgatggtcacggtacggaaatgtccggtgtgctcggggccagccgcaacggcaccggtatgcacggcattgccttcgatgcgaatatctttgtcgccaacaccggcggcagcgacaacgatcggtaccaaggttccaacgacctcgactacaacgcgttcatggccagctataacgccctggcggcgaagaacgtgtcgatcgtcaaccagagctgggggcaaagctcgcgcgatgacgtggagaaccacttcggtacggtcggcgacagcgccgcgcaaaatctgcgggacatgaccgcggcctatcgcccgttctgggacaaggcccacgccggtcacaagacctggatggacgccatggctgacaccgcacggcaaaacacctttatccagatcatctcggcgggcaacgacagccacggtgccaacccggataccaacgccaacctgccgtttttcaagccggatattgaaggcaaattcctcgcgatcaccggctatgacgagaccagcgcccaggtctacaaccgttgcggcacctcgaagtggtggtgcgtgatgggtgtgtcgggcatcccgtccgcagggccggagggtgaaatcatccccaacgccaacggcacctccgccgccgcgccgagcgtttccggggccttggccctggtgatccagcgctttccctacatgaccgccagccaggcgcgggacgtattgctcaccacctccagcctgcaggcgccggatggcccagacacacctgtcggtgagctgacaggtggccgcacctacgacaacctgcagccggtgcacgatgccgccctgggtacgccgcaagtgccgggtgtggtcagcggctggggcctgcccaacctgcaaaaagccatgcaagggccagggcagttcctcggtgcggtggcggtggccttgcctgccggtacccgcgatatctgggccaacccgatttccgatgaggccattcgcgcccggcgcgtggaagacgctgccgagcaggcgacctggacggcgaccaagcagcaaaagggctggttcaatggcctgcccgccaatgcctcggccgatgatcagttcgaatacgagatcggccatgcccgggaacaggcgacgctgacccgtggccaggacctgcttaccggcgccacctacgttggcagcctggtcaagtcgggggatggcgaactggtgctggagggccagaacacctattcaggcagcacctgggtgcgcggtggcacattgtcggtggatggcgtgttgacctctgccgtgacggtggatggcagcgccgtgggcacgcgcaatgcggataacggcgtgctgaccaccttgggcggcacccttgccggcaacggtacagtgggcgtcttgagcttgaacgctggcgggcgcgtggcaccggggcattcgattggcacgttgcgtactggcgacgtgaccttcaatccgggctcggtgtatgccgtcgaagtcggccccaatggccgcagcgaccagatccagagcagcggcgtggcgaccctcaatggcggccaggtgaacgtgtccctggagaacagccaaaacctgctgtccgccagcgaggcgcgcagtttgctgggccagcagttcagcatcctcagcgccagccagggcatcaatggccagtttgcggcgttcgcgcccaactacctgttcattggcacgcagctcaactaccaacccaaccagctgaccctggcgatagcgcgcaatcagaccagcttcgccagcgtcgcacaaacccgcaacgaacgggcggtggcgacagcggccgagacgctgggcgccggcagcccggtctacgaaagcctgttggcttcggattccgccgaccaggcacgggacgcgttcaagcaactctcggggcaactgcactcggatgtggcggcggcgcaaatggccgacagccgctacctgcgcgaagcggtcaatgggcgtctgcagcaggcccaggcgctggattccagcgcgcagattcaggccagcgacaacggcggctgggtgcaactgctgggcgggcgtaataacgtcagcggtgacaacaacgctagtggctactcgtcgtccaccagcggcgtgctgctgggtttggacaccgaggtgagtgatggctggcgggtgggggcggcgaccggttatacccagagccacctcaatggccagtcggcttcggcggacagcgacaactatcacctgtcgatctatggcggtaagcgcttcgaagccattgccctgcgcctgggtggcgccaccacctggcaccgcctggacacttcgcggcgggtggcctacgccaatcagtcggactacgccaaggccgactacagcgcacgcaccgaccaagtgttcgccgagatcggctacacccaatggagcctgctcgaacccttcgccaacctcacgtacctgaactatcaaagcgactcgttcaaggagaaaggcggtgccgctgctttgcacgccagtaagcaaagccaggacgcgacgctgtcgaccctgggcctgcgtgcgcatacgcagttgccgatcagcgccacctcggcggtgaccttgcgcggtgagttgggttgggagcatcagttcggtgacaccgaccgcgaagcctcgctgaagtttgccggcagcgacaccgcctttgccgtcaacagcgtgcccgtggcccgggatggcgcggtgatcaaggccagcgcggagatggccttgaccaaggacaccctggtgtcgttgaactacagcggcttgctgtccaaccgcggtaacaacaacgggatcaatgccgggtttaccttccgtttctaaccttgcacttgatcttcgtgtaggagcgagcttgctcgcgaaggacgccaacgataacgcggggtagcaggaaccccgcgatatcgtctggtttttcgcgagcaagcttgcttctacaaggtttacaattgctgctcccgatcaggagtatccctgtgctgactcatctcgattcccaaggtcgcgcccatatggtcgacgtcaccgataaagccgtgaccttccgtgaggcggtggccgaagcgcgggtgcgcatgttgcccgaaaccctgacaatgattgtcgacggcgcccaccccaagggcgacgtattcgccgtggcccgcatcgccgggatccaggcggcaaaaaaaaccagtgacttgatccccctgtgccacccgctgatgcttaccggcgtcaaggtcgagctacgcgccgatggcgtggatgccgtgcatatcctggcgcgctgcaaactctccggccagaccggcgtggaaatggaagccctgactgccgccagcgttgcggcgttgaccatctacgacatgtgcaaggccgtggaccgtggcatgaccatcgaaagcattcgcctgctggaaaagctgggcggtaagagcgggcacttcaaggcggatcaggtatgagtatcaacgtgctgttttttgcccgctacagcgaagcgattggcctggattcgctggagatggaaggtgacttcgccaccgtcgacgccgtacgccaagcattggcggtcgatccgggcttcgaagtgctcaacgagaccagcctgatgtgcgcccgcaaccaggagctatgtggcctcgacgagccactgcaagccggcgatgaagtcgcgtttttcccacccgtgaccggaggctgaccatggccattcgtgtgcaagtcgaagcctttgatcccggcgctgaagtcaacgccatgcacgccgccaatgtcggcgtgggcgcggtggtgagttttgtcggctatgtgcgcgacttcaatgacgggtgtgatgtgtcggggatgtttcttgagcactactccggcatgaccgaaaaggctttggccaagattgccgtcgaggctgagcagcgctggccgttgctcaagctggaggtgctgcatcgtatcggcgcgctggagccgggagagccgattgtgtttgtcgcggcggcgagtgcgcatcgccaggcggcgtttgatgcctgtgcgtttgtgatggattacttgaagacgcgggcgccgttctggaagaaggaaaacaccagcgaggggccgcgttgggtagacgggcgggacagcgaccacgcggcagcagaccgctggaaatagcacgccaaacacagatgcaaatgtgggagggggcttgctcccgatagcggtggcacattcaacatctctgttgattgacccattgctatcgggagcaagccccctcccacatttttgatcgagttttagccgttaagggcgtttgcgttctacagctcgcagcaagtgcgttggcggcgtctcacaactgatcttgcgccccagcagtgtctcgatcgacggcaactgatacgaatcatcttccccggcaaagctgatcgacacacccgcagccccggcacgcccggtacgaccgatacggtgcacgtagtcgtccggcacttccggcagggtgaagttgatcacgtggctgatgccgtcgatatgaataccgcgcccggccacgtcggtggccaccagcacgcggatcttgccttcgcgaaagccttccaacgtcttgatgcgcttgtgctgcggcacgtcgcccgacagttgcgcggcattgacgccatcgcgcaccaggcgttcttcgatgcggcgcacttcgtccttgcggttggcgaacaccatcacgcgctcccaaccgttgtcgttgaccaggttgtagagcagcttgtacttgtcggcaccggcgacggcgtagatgtgttgctcgacgttttcgctggcgacgttcagcgcctcgatctcgacgatggacgggtcggtggtccactgcttggcgaggttcatcacgtcttcggtgaaggtcgcggagaacagcagggtctggcgctcggctttgggcggggtctggcggatgatctggcggacttgcgggataaagcccatgtcgagcatgcggtcggcttcgtccagcaccatcacttcgaccatgtccaggtgcacgtcgccgcgctggttgaagtccagcaggcggccaggggtggcgaccaggatatcgcagtggcgggcttcgaggtgcttgagctgtttgtcgaagtccatgccgccgacgaaggtcatcacgttgaggccggtgtacttggtcaggtcggcggcgtccttggcgatctgcaccaccagctcccgggtcggggcgatgatcaacgcgcgcggttcacccatgtagcgctctttcggcggtggcgtctgcagcagctgggtgatgatcgagatcaggaatgcggcggtcttgccggtgccggtctgggcacggccgatggcgtctttacccgcgagggtgaaacccagcacctgcgcctggatcggcgtgcagtacgggaagcccaggtcctggatggcatgcatcagttccggggccagcttgaagtcgtggaagcgggtcttgccttcctggggctcgacgacgaagtcttcgagtttccacggggttaccggcggcttgggcgcgcgttcgcgacgtggtttggccgcaggcgccgtagcgacctcggcaggctgggcctgttcaggcggcgtcaccgagggttgtttcggtgcggcggcgggcgtagtccggccaggctgtggaccgtcattgcggttgccgggcttgggggcaggagcactgggaacaggcgcgagcggctcagccgcgcttttgccgaacatcttcttgagtgctttgagcacggtcatctcattaattggttaaggaatatacgccggccagtgtaatgcaagaatcgggcgcggcgtagtgcgtctgtcatacggctacataaacgcgggtttcagcgcaggcgttcagccagccaggtgccgatgtcgcgtatctcttcgggtaacacttcgtggcccattgggtattcctgccatgccacggtgacaccacggcccttcaaatgctcataggcgctacggcccatggcgttctgcaccacctcgtcgtactgaccatgcaggcacagtgtcggaatgcgctgctggctggcggataattccagctcattatcaaaggttggcgcgtaggtggagagggctatgacgccacccagtggcccctcccaatttaagaacgcggtgtggaaaaccacggcaccgccctgggaaaaacccgcgaggaaaattcgcgaagcgtctatcccggttctcttctgagcctcgatcaaatcagtgagcattttcgccgagacttccagttcttccaggctgatcgaacgcgccgggctcatggccttgatgtcgtaccagctcggcatctcgtagccgccgttgatggtcaccgggcgcgtcggcgcctggggcaaaacgaagcgcgtggtcagcaagctttcctgcagcgcctcggctaccggcaggaagtcgtagcgatcggcacccaggccatgcaaccagataacgcaggcatctgcgggcttggcgggctgaagaatcaagggttcggtcatgtctgctccatatatgtgcgcgcgctccgattgggggcgtcggaacggtgcgcgacaggttgatctgttaagagaatgtcgcaagggtgaatcttttgccattaacccagggttgcaagcgcttggccagcactctggtacgcgccttgctatgtgtaggtcgatgtcagaactctcccgggacggtaacactatcagtgaccgccgttcaggggatagccgctggaatgattgcgaaaacctcatgccgcttgaccccaaaaaaagccaacacgggtcgatatcgcctcataagggtgcgctggggttggagcttggacacaacaagagcaactggaggtttgaatgaaggtattgaaatccaccctggccatcgtcactgcggcggctgtattgggtgtcagtgggtttgcccaggcgggcgccaccctggatgccgtgcagaagaaaggctttgtgcaatgtggcgtgagtgatggtctgccgggcttttcggtgccggatgccagtggcaagatcctcggcattgatgccgactactgccgcgccgtagccgctgcggttttcggtgacgccaccaaggtcaagttcagccagttgaatgccaaggagcgtttcaccgcgctgcaatcgggcgaagtcgacatcctgtcgcgcaacaccaccatgaccagctctcgcgatgcgggcatgggcctgaaattcccaggcttcattacctactacgacggcattggctttttggtcaacaacaagctcggcgtgaaaagcgccaaggaactggacggtgcaaccatctgcatccaggccggtaccaccacagagctgaacgtttccgactacttccgcgccaataacctcaagtacaccccgatcaccttcgacacctccgacgaaagcgccaagtcgctggaatccgggcgttgcgacgtgctgacatccgataagtcgcaactgtttgcccagcgcagcaagctggccgcgccgaaagactacgtggtgctgccggaaaccatttccaaggagccactgggcccggtcgtgcgtaacggtgacgacgagtggctggccatcgtgcgctgggtgggctacgccatgctcaacgctgaagaagccggtgtgacctcgaaaaacgttgaagccgaagccaagtccaccaagaaccccgacgtcgcgcgtttgctcggtgccgatggtgaatatggcaaagacttgaaagtgaagaaggactgggtcgtacagatcgtcaagcaagtgggcaactacggcgaaatgttcgagcgcaacctgggcaagagcacgccactggaaatcgaccgtggcctgaacgcgctgtggaacaacggcggcatccaatacgcaccccctgtgcgctgatcgctgatggttctatcacccggtgggccaaccgccgggtgatgttctgttccattctttgcggggcacttcatgcaaaatcaaatcggcgcacccaagcagaagctcagcttcagcgatcccaaagtgcgcgcgtggctattccagatcatcaccatcgtggcggtggtctcgctgggctggtacctgttccataacacccagaccaacctgcaacaccggggcatcacctcgggtttcgactttcttgagcgcagtgccggcttcggcatcgcgcagcatttgatcgactacaccgaatcggacagctatgcccgggtgtttgtgatcggcttgctcaataccttgctggtgaccgtgatcggtgtggtgctggcaaccctgctcggctttatcatcggcgtggcgcggctgtcacccaactggatgatcagcaagctggcgacggtctacgtagaagtctttcgcaatatcccgccgttgctgcaaatcctgttctggtatttcgcggtgttcctgaccatgccggggccgcgcaacagccataacttcggtgacaccttcttcgtcagcagtcgtggtctgaacatgccggcagccctggcggccgacgggttctggccatttgtcgccagcctggtgatcgccattgtcgccatcgtgctgatgacccgctgggccaacaggcgctttgaagccactggcgtacccttccataaattctgggccggcctggcgctgttcatcgtgatcccggcgttatgtgcgttgatcttcggcgcgccgctgcactgggaaatgccccggcttgcaggcttcaacttcgtcggtggctgggtattgatccctgaactgctggcgctgaccctggcgctgacggtgtatacagcggcgtttatcgccgagattgtgcgctcggggatcaagtccgtgagccatggccagaccgaagcggcacgctcactgggcctgcgcccggggccgacgctgcgcaaggtcatcatcccgcaagcgctgcgcgtgatcatcccaccgctgaccagccaatacctgaacctagcgaaaaactcgtcgctggccgccggtatcggttacccggaaatggtttcgctgtttgccggcacggtgctcaaccagaccggccaggccatcgaggtcattgccatcaccatgagcgtgtacctggcgatcagcatcagcatttccctgctgatgaactggtacaacaagcgcattgcgctgatcgagcggtgaggaaacgcccatgacgacgcatacgttcaaacctgacatgccgccgccgagcaaagtcttcgggccggtggcgtggatgcgcgccaacttgttctcaagctggctcaacaccctgctgaccttgctggcgatctacctggtgtacctggtggtgccgccgatcctgcagtgggccattctcgacgccaactgggtcggcactacccgcgccgattgcacgaaagagggcgcttgctgggtgttcatccaacaacgcttcgggcaattcatgtacggctactatcctggcgaactgcgctggcgcgtagacctgacggtgtggctggccatcgtcggcgtggcgccgttgttcatctcgcgtttgcaacgcaaggcgatctacggtctggggtttttggtgctgtacccgatcatcgcctacttcctgctgcacggcggcgtcttcggcctgagcacggtggcaaccagccaatggggcggcctgatgctgaccctggtgatcgccacggtcggcatcgctggtgccttgccgctgggcattgtgctggcgttggggcggcgctcgaacatgccggcgatccgggtggtttgcgtgaccttcatcgagttctggcgcggcgtgccgttgatcaccgtgctgttcatgtcctcggtgatgttgccgttgttcctgcccgaaggcatgaacttcgacaagctgctgcgagcgctgatcggcgtgatcctgttccagtcggcctatgtggcagaagtggtgcgtggtggcttgcaggcgattcccaaggggcagtacgaagccgccgcggcgatgggcctgggttactggcgcagcatgggcctggtgattctgccgcaggctttgaagatggtgatcccggggatcgtcaataccttcatcgcactgttcaaggacaccagccttgtgatcatcatcggcctgttcgacctgctcaacagcgtcaagcaagccgccgccgaccccaaatggctgggcatggccaccgaaggctacgtgttcgccgccctggtgttctggattttctgttttggcatgtcgcgctattccatgcacctggaacgcaagctcgacaccggccacaagcgttaggagtggtttttatgagcgaagcaatcaagcagcctgtgagccctgaaggcattatccagatgcagggtgtcaacaagtggtacggccagttccatgtgttgaaggacatcaacctcaacgtcaagcaaggcgagcgcatcgtgctgtgcggcccgtcgggttcgggcaagtccaccaccatccgctgcctcaatcgtctggaagagcaccagcagggccgcatcgtggtcgatggcgtggaactgaccaacgacctcaagcagatcgaagcgatccgccgtgaagtcggcatggtgttccagcacttcaacctgttcccgcatctgaccatcctgcagaactgcacactggcgccgatgtgggtgcgcaagatgcccaagcgcaaggccgaggaaatcgccatgcattacctggagcgcgtgcgcatcccggagcaggcccacaagtttccggggcaactctccggcggccagcaacagcgtgtggcgattgcccgtgcgctgtgcatgaagccgaaaatcatgctgttcgacgaaccgacttcggcgctggacccggaaatggtcaaggaggtattggacaccatgatcggcctggccgaagacggcatgaccatgttgtgcgtgacccacgaaatgggctttgcccgcaccgtggccaaccgtgtgatcttcatggacaagggcgagatcgtggaacaggcggcgccgaatgacttctttgacaacccgcagaatgatcgaaccaagttgttcttgagccagattttgcattgatcggtgtttgaaaaaacaaacccggcctggccgggtttattttttgggttaggacgctttgagtgcttcagtgtcgttgttcacggtgtaggtgaaggcgccgcgcatatcagcgccttccgccagggctttcgcgtccgcaagcaggtgcgggtggcgatccaagaatcgcatcagcagcaccaagggtttgggggctggaacttcgccgcgttcgtaccgggagaatgcgttgtggccgccaccggacagcaaatccacggcttccttttgcgtaaggtgcagttttcggcggatgcgcttcatctcggcgccgatcatttttcgagcggcgaggactagctcgtcacccgcttcgccatagcgatctgcactatcggtatcggggtcccaaaagccgtcgccgcataccttgcattcccagcctgcaagattgtcgactcgacgctccatgcctttgacgcttatggtttcgctgcggccctcgaaatagctcaatgcatcaggggcgccacagatgtagcacagctcggtttttttcatgggtgtttctccttgaaggagattaccggaggcctaccgtctgtgcagtaagtgaccttgatgtaaatctccctgcctttcgaatgagtgtggtacacgtcctgccagactcgatggtctccataagtggtcatcgacttgtacaacatccagttttgcaactcatagatgacctcctgcatttccccaaggctaaagcacaggtcccagccgcatcgttgtgctgactgggtaaatgctttccttccaagccgcctgacatccgccttgatcaccgccaaatcgtaatgaggtgtgtacttttccataagacacctgagtccaataattaccctatgagggtaattttaccaatcgaaaatactgctcctttttgctgcctaagaaccctagtgcgttgcctttgtaggcaactccgaatagcctgtaggaaaattcatcctatgattggacgaaagcgcaaaccccatgacagacatcgccccactgatcaaacgctccctggtcgaccaggccctggagcagttacgtctgcgcattgcccaaggcgtgtgggccatcggcgaacgcctgcccaccgagccggagctgtctgccgagctgggcatcagccgcaataccgtgcgcgaggccatgcgtgtgttggcgttctctggcttgatcgaaatccgccagggtgacggcagctatctgcgctcgatgaccgatccgttgggcacaatgcgtgcgctgtcccattgcacgctggagcaggcgcaggagacgcggcagatcctcgaagtggaggctgtcggcctcgccgcagtgcggcgcaccgatgaagacctcggcgcgttgcgccagacgctccaggtcagcgccgagctgtatcacggtgacctggaggcttacatcaacgccgacctggtgttccatcgtcggttggtagatgccgcacataacccggcattgagcgagctgtaccactacttttcggccatcgtcggcgcgcagttgcgccagaccctgaacatctcaccgcgtcgccaggccgtgttcgacctgcacagcgccttgctcgacgcggtagagcaccaagaccccgaacgcgccaaatccctctgccggcagttgatcaatgaaccctgaaacccaacgcaagactgaagtcgaagagctgttgatcgacgccgaagccgatgacgaggtggtgcaacacacatcgccgctcgtcacccgcccgtggctgttgctgctgggcctgatcctggtggcgctgaacctgcgcccggcgctgtcgagcatggcgccgctgctcagcgaggtgtccgcgagcctggggttgtcggcggccaaggccgggttgctgaccaccttgccggtgctgtgcctgggcctgttcgcgccgctggcgccggtgctggcgcggcgttttggtgctgagcgcgtggtgctgggcattctgctgacactggccgccggcatcattctgcgcagctccttaggtgaggtgggcctgttcgccggcagcctgatcgctggtgcgagtatcggcatcatcggcgtgttgttgccgggcatcgtcaagcgtgactttgccaggcacgccggcaccatgactggcgtctacaccatggccctgtgcctgggcgccgcgctggcggcgggggctacggtgccgttgagtcattacttcggcggcagctggaacatcggcctggggttctggattttaccggcgctgctggcggcgttgttctggttgccccaggtcgggccgaaacacggtgcccatcaggtcgcctatcgcgtaagaggtttgctgcgcgacccgctggcgtggcaggtcaccttgtacatgggcctgcaatcctccctggcctacatcgtgtttggctggctgccgtcgatcctgatcgggcgcggcctgagtgctactgaggccgggttggcgctgtccggctcgatcatcgtgcagttgttcagttcgctcgccgcgccctggctggccacccgcggcaaagaccagcgcttggctatcgtagtggtgatgctgctgaccctcggcggcctgttcggttgtctctatgcgcccttggatgggctatggggctgggcgattctgctcggcctggggcagggcggcactttcagcctggcgctgaccttgatcgtgttgcgttcgcgcgattcccatgtcgcggccaacctgtcgagcatggcccagggcttcggctacaccctggcctccatgggcccgttcgcagtcggcctggtgcatgactggaccgggggctggggcgctaccggctggatcttcgccgtgatcggcctgggcgcgatcgtggcgggcctgggtgccgggcgggcgcgctatgtgcaggtctccagcgagaaggtctagaggtaaaccacttccagcgtggccgagccatccaggggcgtgtcgacgctcaggtcgaggttgcgccgggcgctgatcacggtgtggatactcacggtgccggtcagcgtgccaatcgccgagggcccggcgacgctgccttcgatgtcggtaaagcccaggtagctgttggcgccgatgtcgatggggttgaggttggcggtgcgccaggccacgccgccggtggtcgactcggtgccgtagatcgacgcgatggtgtccgcctgggtttgtcgtgggtcgaagctcatggagtacaggccgagacggttgccgctgtggtcgaaacccagcccgtagtaaatctcactgttgaccgtggccgagccgtcgcggttgtcgcgcatgcgcagggcatagcggctgggcgcattgcagtcgatgctgatctgcagagtcttgacgggcaggcgcgtgccttgctcgaggttcaggtcctggtgggaaatcttgccgtagtcgattactccgcctgcggacaacagtggcgtgcaagccgtggggatgatacggcccaggacactcaggtcgatgctggaggcggcttgggccggcgcggcgctcagcgcaagcaacaaggcgggcagtgcagtgcggtggatgttcatcaggcgaactccttacaagtagatgatttcgatggtgccagagccgttgatacgcaccacttcacgcaggtccagcgattgtgtgggggccaggtaggtcttgatgcgtacggtgccgctcaggttctggatagccaccggccctgtggtggtgccgagcctgtcggtgaaacccatgatgctgttggcggccatggggatctggcgctggctggagctgctccaggccacgccgttgctggtggaatcggttcgatacagcgatgtgaaggcatcggcggtgaattccgccgggtcgaccgtaacgaaatacacgccgattttgttgcggccggcatccaggtccagaccgtaggcggtctcatcgataccaccggtggccgagccttcgcggttatcgtgcatgcgcagggcgaacggggtcggcgcatcgcaactgacggcaaagcccagggtcctcaggggcatcggggtttcggtggtggcgttcaggcttttcgccggcaggacgccgtaatccaccacgccatgatcggacagtgacggttggcaggcggccggggcaaaatgcgcgcgcaaggtcagttcgcggtagcgcccctgcaacggcgagtaaaaggttccggacacttcccaggtggtggcgtctcgcacccgggtggcggcactgtcggcccaggcgcgcagcgtcagttgcagggacagggtgctgcctgtgaccacgctgccctgcaaggtcggtgcgatgccatggccggcgtgccagtcctgcacactggcgttgctcagcggtggctgcccccgggcggcgagcaagcctaactccaccgctttgccatcgaccacaccgttgctggcttcaatctggtagtgaccgtgctcggtaaattgcagttgctgcgcatcggcggccagggcgcggtagaacaggctcaggtcttggggctgggggcaattgaaggtcaggctcaggcgccgttcgccgagcaggcgttgtggcgcactgtcgttctgggcgatacggctcatcaagccgaaatccagcagcgattcgctgagcgtgagctggcattcatctgcagccaggacgttgccggccaggccgagcagtagccacaggctgatagggcgcaagaaagtcatacgggacatcacggtgatcctcaaggcgtttggcatcgggcaggggcagtttcgaaatacaccgaggggtcggctttcttcggcaactcgaagcgcaacacacaacggctgcctccgggcaaagtgacccacagcgtcggctgctccaacacattgggcaggaacacttggctggagtcctgcaccagggtgacgaactcaccctctgcggtgctgaccgaggcgcccctcggcaagggcgcgccctcatcggtgctgacggtgagcaatgcgcggcgcgtcaggcccacgccgaactcgacccggtccaccgcgccgcggcctgcggcgatcaccgccaggccgttgttgatatcggcgttgcgcggcagcgaacgggtctggacctccaccgggctgcgtccataggcgctcacctggggcactaccgcctggccttgccaatcggtccagaccggcccgctgggcgtgctgaccttgatcccgctcatctcaccgaccgagagcagggcgaaggtgtcgcgcaccgggtagggtgagaaggtcacgccatcaccatgcagcaccacgccgccgcgtgcgccgccctggtagctggaacgctcggcgtcggagcggctgtagctcaagtcgagttgggtgtagcgcggcagggccgagaggcccagggtggtttccacttggttatcgcgggtgtcgtgctcggcgctgacgcgatagctcaattgatcgtcgagctggccgttgatacccacgccggtgcggtgttcgccaccggaattacgtgcccaggcgcgcatccggcgattctcgcccaggggcaggctgatattcaggtacacggcattgtcctgttgattctgcccgcccatctgccattcggcgctggcagacagtgataccccgccgacgctggtgccccacgacgccaggcctcgactgctgctgcggccgtcgaagctagcggcgcgggaaaacccggcactgaaggcgccgagccaggggtgggaccagcccaaggtggcgctttgctggtcgcggtaacgcgaacgactctgctcgttgctgacctgacggtaggtgctttcttccagctcgcgatagccggggctgcgccaggaattggcgacactgaatgaccatcgctcattcaggcgctgtgaccaggacaggtcggtctgcacgccagacacctgttcccagccgctgctatcggagagctggctggtcagttgcacttggctgtccagccagggcagccagttcaggctgacgccgctggcacggtagtcgtcggccaccgtcacgccgccgccgacgctcagttgcgcgtgcacggggccggtccagccggcgctggccacccaggggtcggtgccctgtgcatcgccgatattgcgcacgcggcccgccgccagggagtagcccggggccggcaaaccgaggcccagcatcgccgccggcacggtgaaccgccgttcaccgccgacgctttccttgatcgtgacctccacatccgaacgggtgttgaggcgccgcacatcgctcagggcaaatggcccggcgggcaccaccgtggaatggatcaacgccccgttctggcgtacctcgacttgcgccggactgttggcgatgccttcgatcaccgcgccctggccttgctcctgcagggcttgctcggtgagtacctgcaccccgttgatctgcgcgccggccaacaccgggttatagaggttgatctgcccggcttgcagcaccgcctggtggctggcgaaggtgcgctgggcataggcttccaggtgggtgctgcgtgacaagccgtcctgccaggtttgcacctggcggctgcgtacgatccagtcgccggcattgaacccgatttcagtattggccgagccgaaccggctggcatcatcgccgtaacggttgtagaaaccactgaggtcgtagttgagcagaccggcgaacccaccggtttcataccccgaaacatcctggggcaccgggcgtaaggcatcggtgggcaccaccagcgccaccgagagcgtggccggatccggctccaccaggctttgcgggtactgcccgataaagtcgtggcacgggccgctgtcgttgggcgtcagtagatgggcagcctccagcagggcgcgatcgaagcacagcctgccctgctgatcgaacgccacctctagccgccctcgacgctggccgttgacccgcagggtgatcttatgccggccagcggcgaaacgcggcgcgtccagcagcaggctcgccagttgcggatcaatgccgcgctggttcagggtctgtgcgtcgaagcctggccttggcgcggcgtcgggccacgccttggccggcaccagtgcgcacagcaataccagggtcgccaacggtggacgggcagatgcagcgggcacggcttcgccgtcacggtaactcaggactgttttcacgaaaggcactcaatctggtggacgcccggtgccggccctggctacgttggcggcgtcctggcaacggtcgatgcgccgtcactcgttatgcaggcgcctgcctggcgcctgttggtttcaaagggtgataggcgcgtcgtaggcggccacggcaaagccatacacggtggccggctgcagccgcacctgggtcgctggcccgccggtagccggcacattgagggtttcgccgggcagcacataagtgcgtggcaaggtcgcctggccgtcgccgggcagcaggcgcagttcctgggcgaggcgcaccacatacggcgtatcgttacgcacctgcaatgtgccgtcgcgcagggtccaggtcaggtcggtccagggtgtgcgattaatcgccaggcccttgggatgcacgatcaccggcaggttctggcgtacggtcacgccgacccgggcgtgcccggcttcggtggcggcccggccctggggcatgccttcaaaaatcgcgcgtttgaggcgctgagtgcgcaacggcgcctggttttgcaggatgaagcgcaccagttgcgacttgccgctttccaccctggacaacggtggcgtcaccaccagcagcggctcggagtcttcgggaatgtcttgcaaggtcacgtgcagcaaggccaggttgctgtcggtgttggtgaccgagacagccgcctcaccatcggcttcgtggatgattaccacggaggtgtcgggcaccatgccgtcagcctgggcattgaggctcaacagtaaggccagggtcgcaagtgtgaggcgtgtcgacgtcatgacaaagtttccattgggcaagtgagtggttcagaggtagcgcaagtccaggacgacggaaccgtcgaggggcacttcctgatccagggtcaggtactgcgaaaagttgatcgaggtgtcgacccgcagttggacgttcaactggcggatgaagtccggtagacggtcgccgggcagggcaaaccccatgtaggacctgggataggcattgggctccgccgcccaggtttcgccgctgtcgtaggaagccaatacctgcatcgtctgggcgtcgcctaccgggttacgcaacgacagtgccacggagccgaggcgttcttgcggggcgtggacatttctgcccaggccgtagaagtaatccggtgccagggatgaatccgcacggttgtcgatgcccaccagggcaaacagcatcggccggttacagcgcaccgtcagttccagcagttgagccggcaatacggtgaattcgtcgctgctgagggtgtgggcgggaatgcggccgtgatcgacggagccgttgtcggacagttccacattacaggcgtcaggggtcagcctgccggtcaccgtaaggtcgacgaaggaggccgcgagcgccggggcggccagtgtcagtgcgagtacgacagcaaaaaggcgagggcgcatgttcatcggtgcaggtcactgggtcgaatgagggtggccgatacgaaaaaaagcccatgcaggccggtttccaggccggcatgggcgtacagcagattagagatacatcacggtcagggtggctgaaccatcaatctggacttcattgctcaggtccaggcgatccgtgcggttgatggtggtatccacctccaggtccagcagcagttcttgcaccggcaccggctgagtcgggtcactcatgtcggctaccgaaatgtaaaagttggggtcccagaatttttcaaggaaccaattgtcctggccgttgatagaggcaatggactgcactgcgacgccgtcagcgatggggttaatgactctgatgtgatagtggccgagtttctcggtgccattgatcaggcccaaaccgtaatcgccgttactgatagacgagcctttacgattgtcttccgattgcagcgcaataagggtctgcccctcgcagaccaccgccatcgtcagggtgtgcaaaccaatcattgtcgggttgtcggggttgaggtccttggcggaaatcttgccatggtcaatcacgccgccactggacaggctcggcgtgcacgcgctggggacgatcaggcccttgaccgtcaggtccacggtcgaggcagcgaaagtggttgtggtggcgagcagcagcgtcgcgctggtcagtgcgccaagtagtgttttcatgggacatgttccttcgatggggtctgtatgcagcggttacaggtacatgagttgtacggtggcgtggccgtccaccggcacttcgtcaagcagcgtcaggctgtcgctgggcgcgatatgggtgttgagcctgaggttggcctggaactggcgcaccgcgaccggcaccggcacgttgttgatcgccactgccgtcaatacggtggggttgagctgggtgcccagttgccacgtcgtgccgccatcgcttgagttgatggtctgggcgggcaggttgtcggccagcgggttatacaggttgaagccggcgccgccgatcttctcgccttctgcggtcatgcccaggccatgccagtgcgggtgattggcgctggagccgggccggttgtcgatggtgttcagggtgaacagcgtcggcccttcgcagctcacgctcaattgcacggtctgccggggcagcggagtgtattggtcggcattgagctctttggccgacatttttccgaaatcgaccacgccgccgccggtaatcagggtttcgcaggcgctgggggtaattaccccggtaacggtgaggtcctgggaactggccgcgaaggcggggggcgcgcaggtaatcaacagaacgctgccaagggcaaccaaatgcttgttcataaatgtgttgttccggtgtgtgaccaacaggcgaaaacagacccatggcgacccactgcagcaaggcaagtgctttcaggtctggtttatagccgcccttgataaatgtggcgggtcgttaccctctggcggggtgcaaacaatttagtcagcgccgttacacacggatatacaacttttacgacattggcccagcggcaagtaaagggaggcggggtaaagctatttaagcgagaaagtttttttcgtagttgttgtatcgtcagtcatacatctgaaaggatattttgagtgtgcgattacagttatttgaacggctttgagggctgcgctatgcagcgccttgaatgtctgttcctggctgttacgtcagtgctgcccgaactcaagtagtactgcaaggagcacctgatgaggtaagcgggcgtgctttcgagcgatgtcgcttcgcagaaaaactgatgcgccatgccgcgacaccggcacattggcgacaacagtgtgtattggtagtggaggatcactgcgtcttcagggcgatgatgggctggcaactggataagctcgggctgagccaccacttggtcgagaatggcagcagtgccatggcggccattgcgtgccggcgttttgacctggtgatcagcgactgtcagatgccggtcatggatgggtatagcctggcgcgtgccatacgccagcgcgagcaagacctggggtgtgagcgagtgccgatcattgcgctgaccggcaacctggtgcacgacgacccgcaacgctgccgcgacgccggcatggatgcctggttgctcaaaccgctggcccttgaaccgttgcgtgacatgctgatgcgctggctgcccggcgagcgggtagcgcttccgagccggtcgccgggcgtttctgcgccggggtggcctacccgcgccagcctggtcgagctgtttggcagcccgcaggtcgtggatcagatgctgcgtagcctgctcaccgaagcgctgctggacacccaggcactcactcacgcacgcaacgccttggatgccagattaactgctgagcgcttgcatcgcctggtaggcagcctggccttcttgggtggcgcggggctggagtccaggggcagcgccttgatcagtgaggtacgtacccatggcgtggcattcaaccagcacaagttggaagtgttccagcgcgatctggcggcttatctcgactacttacgtgaattgtgacgatttgtcgaagttgaacggttttgtcgtgactttggagtgtaagaattttccttttgttctgtaagttcaaaactacccccttcaaaacatggggtgcggctgaacctcacttgctgttaccggttgttaccaatcgccagcaaggttattttgcgtgcattcaatttgccatcattcgtgggtatgtatgcttcgtgtaattattgctgacgatcatcccattgtacgtattgggcagagagtggtgattgaggcgggcggcaggtgcaaggtggtcgcggaggccaacggtcccgatgagttgctcaacttattggccaaggtaccttgcgatgtgctcgtcactgacttcgccatgcccggggggcagcaggccgacggttacggcctgttgagcctgttgagtcgccagtacccggcgctgccggtgattctggtaaccatgttcgccaacatcgctaccttgcgcgcctcatttgcccatggcgcacgcgccatcgttgccaagagcgcctcggccaaggaactgcccctggcgatcaaggcagtgtgcgccggccagaacttcgccagcgagtccctgcgcgagcagttggtggaggcagggccgggtgatcaatcgcaacagccgcagctgtcgggcaaggagcgcgaggtggtgcgcatgctggccagcggcatgaccgtcagccagattgcggcgcgggtcaatcgcagtatttccaccatcagcaagcagaaaagcacggccatgcaccggttgtgtatatccacggatgtggacttgttcgcttatgcgcgtgccgcaggcatggtgccttagaaagttgcagttttatgacagtggttgattaactagtgtgcgattttggattcgtattagttgtattcagctcaaggtcgacctgctctaagttgtgatggtctttctgtcgttactgcgatgggctgacatccctagtctaattagttgagtcgaacttcaggttggcaaaacgccggagtgcgttgttcgatccgttgataatcggccgaaagtgagcattgatatgcaaccgtctcgtgcacttatgaccgccgccctttggctggcgggtgtttccaatgtaatggctgcgtccagtgtggacctcagtgtggtcggcaagatcacaccggcagcctgtacgcctctcttgtccaatgccggcgtggtggaccatggcaagatctcggcccaggacctgcatcctaccggctacacgaagctgccggacgcctcgcttgagttgtcggtcacttgtgatgcgcccaccttgctggcggtcaagagcactgataaccgtcccggcacctcggccgagcagttgggctcggcttcagtgtttggcctgggcctggccagtggcaatgaaaaaatcggctggtacagcctgatgatggcgcaagtgagcgccgacgacgtaccgggtatgccgattgagtcggccaatggcaacatgtggctcgatgctgcgggcaacacggtctggcagccgggctttctgcgcagcatcaaggacccgggcaacgccactccgacaccattggcgatgaccaccttcaagggcgtgctggaggtgtccacgacactcacctataagagaaacctgccgatcagcgaagagatccagatagacggcagcgccaccctggaagtggtctacctctgataccgccgggcatcgctcatcgacgcggtgaatagccatggctttcccacgcggtgcggactatcgttcagtccttcctgaaccacgtgcgaagcctgcccatgagtgatgcccataacgccctgattacccagttctaccaggctttccagcgcctggacgctgaagccatggccgcctgctacagcgacgacgtggtgttcagcgacccggctttcggtgagctgcatgggcgtgatgccggtgacatgtggcgcatgctcaccacccgtgccaaggacttctccctgacgtacgaccaggtgcgcagtgatgaaactactggcagcgcgcactgggtggcgacctatctgttcagcgccaccggtaataccgtggtcaacgatatcggcgccaggtttgtgtttcgcgacggcaagatctgcgaacaccatgaccacttcgacctgtggcgttggtcgcgccaggcgttgggcctcaagggcctgttgctcggctggtcgccagcgctgaaaaacgccgtgcgtgcccaggcacgcaaaggcttgaaggcattccaggccggtcgttgataagattggcctccctgcggtttgccgaaacgacttgtgactgatccttctgaatccaaaccctggtttgtctacctggtgcgcgccgccaatggctcgctgtattgcggcatcagcaatgatccggtgcgccgctttgcctcccatcaaagcggcaagggcgcgcggtttttcttgtccagcccggctgttgcgctggtttataccgagcagtgtgcaagcaaaggggaggcgttgcgccaggagcggctgatcaagaagcttaagaagagcgccaaggaatgcctggcggcgagcggctcgttgattgacaggggcggctagggcatccgagaaaatattttctgattcaggtgaggtaaacccacggcccatccgtgtagtgcatgaactgcgatctattcgcattaacagcgttctctacacgggttctcacagcatgaagtcagcggcaggcggttgggtaaaacagtggctgggagcctcggtattagcggtgtcggggttggcattgctgccgcttggcatcgcccaggcgcaggagcagcaaagcgcccagttcacgtttgccctggccgccaaaccgttgccccaggccttgagtgatttcagccgggtcacgggcctgagcgtgatctataccgatgacgcgccctatggcctcaatgccccggccgtcagcgggcagatgagtgcgacccaggccctgcaacgcctgctgagccattcaggttttaccttccgccagatcgacgcccgcaccctggccctggagccggtgcctaccgacgcagcggtgagcctcggcgccaccaccatcagcgcagccaacccgacccaggacagcaccagctaccagccgccgcccaccagctcggtgatgcgctccagtggccttttgctggaaaccccgcaaaccgtcaacgtggtgccggcccaggtgctacgcgaccaacagccgcgcaacctggatgacgccctgggcaatatcagcggcatcacccagtccaacaccctcggcagcacccaggacgcggtgatgttgcgcggttttggcgacaaccgtaatggctcgatcatgaaggacggcatgccggtggtgcagggccgggccatgaacgcgaccgccgaacgggtcgaagtgctcaagggcccatcgtctttgttgtatggcatccaggacccgggtggcgtggtcaatatcgtcagcaagaagcccgagctgatgcagtccacctcgctgaccgcccgtggctcaagcttcggcagcggcaagaacggtagcggtggcaacctggacaccaccggcccgctcggtgacagcggcctggcctatcggctgattgtcgatcatgaagatgaagactattggcgcaactacggcacccaccgtgagacgctggtggcgccgtccctggcctggtatggcgacaccacccaagtggcagtggcctatgagcaccgcgaatttgttgcgccgttcgaccgtggcaccgccatcgaccccaagaccaaccatccgttgaacatccccgccacccgtcgcctggatgagccattcaacaacatggaaggccgctcggatttgtaccgcctcacggtcgatcacgatctgaacgacgactggaaggcccactttggctacagttggaaccgcgagacctacgatgccagtcaggtgcgcgtggtcaaggtcaacaccgatggtaccctgacccgcagcatggatggcacccagggcgcgttgaccactgaccgttttgccaccgccagcctcgagggcaaggtgaacgtggccggcatgcaacatgacctggtgttcggcctggacgacgagtaccgcaagatctaccgcgccgatctgatccgccaggcgccgcgtggcacgttcgactacaccaacccggtgtacggcaacgaagtggcggggtccaaggtcagcgccccggacagcaaccagaccgatctgctgcgcagtgattcgctgttcttacaggacgcgattcacctgaacgatcagtggatcctggttggcggcgcgcgctaccagatgtacgaccaatacgccggcaaaggcgtaccgttcactgccaacaccgatggcaacgggcagaagtgggtgccgcgtgccggcctggtgtatcgctacaccgatgagctgtcgttctacggcagctataccgagtcgttcaagcccaactccaccatcgcgccactggcgaataaaaccgtgctggacggcagcctgcaaccggaagagtccaaggcctgggagctgggcaccaagttcgatatgccgggacgtatcactgcgagcgcggcgctgttcacgatcgacaagcgcaatgtgctggtgcaggtgggtgaaggcttgacgtcggtctacagcgtggcaggcaaggtgcgctcccgtggtctggagctggatgccagcggccagttgaccgacaactggagcctgatcggcagctatgcctacaccgatgccgaggtcaccgaagacccgacgctcaaaggcaaccgcctgcagaacgtggcgaaaaataccggctcgctgtcggcggtgtatgacttcggcagcatcttcggcggtgatcaactgcgggtcggcgggggcgctcgctatgtgggcgagcgtgccggggacgcggccaacagcttcgaactgccgagctacaccgtggccgatgtgttcgccagctatgacaccaggcttgaggggcagaaggtcaagttccagctcaacgtgaagaacctgttcgaccgcacttactacacctcgtcggtgaatacgcagtttgtgtccataggcgatgcgcggcaggtatcggtgtccagcaccctgaccttctaacgccatccctttgtaggagcgagcttgctcgcgaaaaacgtcaatgctcacgcgggctgcctggtttaacgcgttgcctgtgcgttcttcgcgagcaagctcgctcctacagtgttagcgttgccgttattgttgattttgcgggaacggcacactgatgcactttggaaaatggtttcacaccagcaccctgctggtcggcttgagctttttactgggtggctgcgccagcgtttcgcagacgtccacgcctgccaccctggacaaactgttaagcgacccggcgctgcacggcgccacggtgtcgctgatggtgcgcgatgcccgcacgggcaccacgctctaccagcacaacccacgcacacggttggtgcccgcttccaacctcaagctgctgaccaccgcggcggcgatggatgtgttggggccgcagtaccgtttctctacccagttgctcagtgatggcatacgccagggcgaccgcctgaccggcaacctgtacctgcgtggcctcggcgacccgagcatccagttcgccgactaccaggccctcgccgcgcagttggccagccagggtgtgcgccaggtgcagggcgacctggtgttcgatgacacctggttcgatgccgagcggctgggtgtcgactggtcccatgatgatgaaaccacctactacggcgcgcagatttcggcgctgactgtgtcacccaatgcggatttcgatgccggcagcgtgctggtcaccgccaaggcgccgttgcgggccggctcgccagtgggtgtcgatattttcccgcccaccgattacctgcaactgagcaaccgcgccgtgagtgggccgggcaacacctatggaatcaaccgccgccatggcaccaacctgctgcaactcagcggtgcggtggctccggggcgacagagccagcaactgatcagtgtctgggagccgacgcaactggtggccaatctgtttgagcaggcgctggcgcagcaggggattaaagtattagggcgtcgagtgatgggcgcggcaagtccggcagcagtgacagtgctggccgagcaccaatcggcgccattgcaggagctgatcgtgccgctgctcaagctctcgaacaacaacatgtccgaagccttgctcaaggccatgggccgccagaccgccaacagcggcacggcggcggcgggcgtgacggcggtggccgggttcttgaagcgccagggggtggacacaagcagcctcaatcaagtcgacggttccggcctgtcgcggcgcaacctggtgtcggcgcaaaccctcaccgacctgctgctggccgcgagcaaacagccatggttcaacgcctggtacaacgcgctgccggttgccggcaacactgaccgcatgacgggcggcagcctgggttatcgcctgcgtggcacctcggccgaaaacaacctgcatgccaagaccggctccatgggcggcgtgtcgtcattgagcggctacgttaccgacggccacgggcgcaagctcgtgttctcgatgctgaccaacaattatgtggtggccggtgcgcaggtcaaggcgctggaggatcgcctggctgtggctttgtcacgcagcgaggattgattcagggctgatagcccatgcgccaactcacggcccgggtcgccgccagcagatgctgcgccgccgggccatcttcatcggcgtggaacagcgacgtcgggccgactacggtcatcaccgctgccacctgcccgacggcattgaacaccggcgccgacaacgcatccacgccgggcatcagcaagccatgcacaaaatgcaggccacggctgcggatctgctcgcacaccgtggcgtaggcctgatcgtccgccagcgagtgggcgatgccggcttgaatctcgcgttcgcgcaattccacggtttcccgcgacggcaggtaggcgctgaacaccagcccggtggacgagctgagcagcggcaacaccgagcccagctgtgtgaccacagtgacggcacgcaccgccggttcgatctgcaccactgttgcgccctggttgccccacaccgccaggaagcaggtttcattcaattcatcgcgcagctccgccaggggcatggcgccgactttcaacacatccatgctgcccagcgccgccaggcccacgcgcagtgcttcgcggcccaggccgtaatggttggtggcggggttctgttcggcaaaccccgaggcgatcagcgcctgcaaatagcggtggaccttgctcgccggcatctgcacatggtcagccagacgtgacagtgaagtggccggagacagttcggccagggccttgagaatatcggtgccgacttccgccgagcggactttctgtttaccggtgtcgcggggcttttccatggaagggcgagaatccgagagatgaatgggcgtctttatagcttgacgctcgatagcgatcaaattacgttatgcgtaactggattacgataaaaacaacttgtgtacagaggatgatccatgcacctcgaatatctatctggctttggcaatgaattcgccagcgaagccttgcctggcgcgctgccggtcggtcagaactcgccacaaaaagccccttacgggctctataccgaactgttttccggtaccgccttcaccatggcccgcagcgaagcgcggcgtacctggctgtaccgcatccagccgtcggccaaccacccggcgttcatcaagctggaacgccaattggccggtggcccgctgggcgcagtaacgcccaatcgcctgcgttggaaccccttggatcttccgagtgagccgacggactttatcgacggcctggtcggcatggtggccaactcggggtcggaaaaaccttcgggcatcagcatctatcactaccgcgccaatcgctccatggagcgcgtgttcttcaatgctgacggcgaactgctgatcgtccccgaacagggtcgcctgcgcgtcactaccgaactgggcgtgctggacgtcgagccgctggaaattgtcgtactgccccgcgggctgaagttccgtatcgaactgctggacgcgcaagcacgcggctacgtcgcggaaaaccacggcgccccgctgcgcctgcccgacctgggcccgatcggcagcaacggcctggccaacccccgcgacttccttacaccggttgcccactatgaagacctcaagcaacctacaacgctggtacagaaattcctcggtgaactgtgggcctgcgagctcgatcattcgccactcaacgtggtcgcctggcacggcaataacgtgccgtacaaatacgatctgcgccggttcaacaccatcggcacggtgagtttcgatcacccggacccgtcgatcttcaccgtattgacttcgcccaccagcgtgcacggcctggccaatctcgactttgtgattttcccgccgcgctggatggtggccgagaataccttccgtccgccgtggttccaccgcaacctgatgaacgaatacatgggcttgatccagggcgcctacgatgccaaggccgaaggcttcctgcccggcggcgcgtcgctgcacagttgcatgagcgcccacggcccggacggcgagacctgcaccaaggccatcaatgcagacctggcgccgcacaagatcgataacaccatggccttcatgttcgagaccagccaggtgctgcgcccgactcagttcgccctcgagtgcccgcaactgcaacccgcttatgaccagtgctgggccgcactgcccgccaccttcaacccgaatcggagataacccatgacgcaatcaacgcttgcccgcagctgggtggcctccgccaacggccacgcggatttccccctgcaaaacctgcccctgggcatattcagcatcaatggctcggcaccgcgcagtggcgtggcgattggcgacgcaatcctcgacctgcatgccgcgttggatgagtttgacggtgaagcccgacgcgccgtcgaggccacggcgggtggccaactgaacgcgttttttgaactcggccgtggccctcgggttgccctgcgcgagcgcctgctggaactgctggccgaaggcagtaagctgcaaacccgcgaggcgcaggtgctgcaccgtgccgccgattgccagatgcacttgccggccaggatcaatgactacaccgacttctacgtcggcatcgaacacgcgcagaacgttggcaaattgttccgcccggataatccattgttgccgaactacaagtacgtgccgattggctaccacggccgtgcctcgaccattcgcccgtcaggcacggatgtgcggcgccccaagggccagaccctgccggccggccagaccgagccgaccttcggtccctgtgcacgcctggactacgaattggaattgggcatctggatcggccagggcaatgccatgggcgacgcgattgccattggcgatgccgccgaacatatcgccggcttctgcttgctcaacgactggtcggcgcgggatatccaggcctgggaataccagccgctggggccgttcctgtccaaaagctttatcaccagcatctcgccatgggtggtgacggccgaagcgctggagccattccgtaaagcacaaccggcgcggcccgagggtgatccacaacccttgtcgtatctcttggataagcgcgatcagaacgcgggtgcctttgatatcgaactggaggtgctgctcaccacggcttcgatgcgtgagcagaacctgcccgctcatcgtctgactttgagtaacaccgaacacatgtactggaccgtggcgcaaatggtcgcgcaccacagcgtcaacggctgccagttgcaggccggtgatctgttcggctcgggcaccttgtccggtccgcaaccggggcagtttggcagcctgttggagatcaccgaaggcggtaagaagccaatcgaattgcccagcggggaggtgcgtaaattccttgaggacggcgacgaaatcatcctgcgtggccgttgcatccgcgaaggttttgccagcatcggctttggtgaatgtcgcggcaccgtggtcgcggcgcgctgagagggcagggcaatggaactctatacctactaccgttccaccgcgtcgtatcgggtacgaattgccctggcgctcaagggcctggacttcaccgcgctgccggtcaacctgctggtgccgacaggcggcgccaatcaccagcccgagtacctggcgatcaacccgcaagggcgcgtgccggcgttgcgcactgatgaaggcgcgttgctgattcagtcacaggcgatcgttgagtacctggaggaatgttatccacaggtgccgctgcttccgaaagatcccgcgtcccgtgcccaccagcgcgcagttgcgtcgatcatcgcctgcgatatccacccgttgcataactccagcactcaaaacctgttgcgtaagtgggggcatgatgaaacgcaactgctcgagtggatcgcccattgggtcagtcagggattgggcacggtggagcagttgattggcgatgacgggttttgcttcggcgcgcagccgggcatggcggacgcgtttctgataccccagctgtacgcggccgagcgcttcaaggtgccgttgggcgcgtacccgcgtatcggccgagtagcggcgttggcggcgcagcatccggcgtttgtgcaggctcatcctgccaaccaacctgacacaccttagctttcagaaattgcctaaatccaaatgtgggagggggcttgctcccgattgctgtgtatcagcaataagtttgtcaactgacacaccgctatcgggagcaagccccctcccacatttgatcgtgccaacataaaaaaaataaaggtcccttgcgatgcacaatcagattgccagctttcgcgcggcactcgacgtccgcccggtgtcgcgttatcaatggttgattctcctgttgctggcactgctactggtcaccgatggctatgatgcccaggtgctgggttatgtggtgccggcgctggccaaggattggggcctggaaaaagccgcgttcggcccggtcttcagtgccaacttgctcggcctgaccctgggctcactgctggtgacgccgctggcggatcggtttggcgtgcgacgtattttgctggcctgtgtgctgatctacgccagcctcacagtgctgatggtatttgccaattccctgaccaccctgatgacggcgcggtttatctgcggcatcggcatgggcggtgctatgcccagcgccatggcgttgatgtcggaatattcgccgcctcgcttgcgcaccttgatggtgaccttggccgcgtgtggcttttcgttcggcggcgcggcgggcgggtttgtagccgccggctttatcgacggctttggttggcaggcggtattcctggccggcggtgtgacgccgttgttgctgtttccattcctgatgtggctgttaccggaatccctgccgcgtctattacgcgataagccgccgtacctgcgattgcgcaaggtcacggcgcgcatgttgcccgactggcaaccgccactcgcgagcgaagccgaaaacctgcgggagcagggcagtaagttcacggtggtggaactgttccgaaatggttacgcgcgcccgacgttgctgatctgggcgaccttttttgtcagcctgatcctgctgtacttcatgatcagctggttgccttcactgctgctcgaaagcggcctggcgctgaatgaagccaacctggtcacctccatgttcctgttcgccggcaccttgggcgcgatcctcatggcctggtttgccgaccgcctgaaaagcaaagtgcggctgctgtgcggcgtactggcggcagcggcgttgtgcaccgtcctgctgggcttgaaccacgacaacccacgctacctggtggcctgcgtgtttgccgccgggttctgcatcattggcgggcaactgaccctcaatgcgtttgcgagcaatttctacccggcgcaggtgcgcgccaccggcacgggctgggcattgggtgtggggcggttcgggtcaattctggggccgttgtttggcagcctgttgctggcgatgcatataccggtgcagcagattttctttttctgcgcgattccggcggtgatggcggcgctgttgattatccaggtgcgctcgccgggcgtgagcgaacccatagacccggcgcataacgacattctcaaggcgtcctaatgcaccactgaattgggcggcaggtgccccagccgctcggtcaggcgcagacgctggatggggtcatcactgagcatcagcgcatgttccaggtcaaagcgttcagcactcgggcagtccaggcgctggtacaggctggcccgcgccaggtagtcggcggcgttggcactgcccagttccagcacgcgctcggcgtctaccaaagcggccagcggttcgtcgttggaaaggtgcagttggcgcaggttgcgcgacaagcgttgcagaatcgcccgtggttcggcggtatgcaggtggtcggcctgcaacttgagtttcggcccgtattgccggtgcagcagctcgcgacagtcattggggtacaggcgccgtccaccgcacgggtcgagcaggtgatcggtaccgggcacccgcagcaggaagtggcccgggaagttcacaccgaccatggggatatccaggcgccgcgccatttccaacgcgatcaggcccatggccaagggctgcccgcgtttgcgttgcagcaccttgtcgagcaatgcggcagcgggacgcaacggggtgtggtcatcctgggcgaacccgaggtcattcatgcgccgcagcagcggttggcccagctcgtccgccggcaacatgggcatgcccaggctgacctgttgttgtagcgcggtgagatcctgcaggatcaacagtggctgcacactggcatcgtgttcggcagcaatccacagcgccgcttcgaacagcgcagggggtgaacggtccaggcaggcgaaaaaggcggtgcggggattcattgcgttctccggcggatgcccctgttttagccttgcagggaattttcgtccagcgtcttaagaaatatcccgcgctcttatgtcgtagatcccacgaaacagcgcggcttattccagtgcaatccagcagttttctaccgccggcctatacttggcccactaccagaagtaattcgggagctcgaagatgtttgcgctcatgcacagcacccgcctggaatcgctgcacctgagcgtagacccggtgaccgggttgaaggcgatcattgccatccacgacagtcgccgcgggcctgctttgggcggttgtcgctaccttgcttaccctgacgatgaaagtgccgtggccgatgctgcgcggctggcccaagggatgagctataaggccgcgttggctgggctgccggtgggcggcgctactgcggtaatcatgcgtcctgcgcacgtggaaagtcgtgcggccctgttcgaagcatttggccgctgtatcgaaaaactcgatggccgctacatcaccgccatcgacagcggcacctcagtcgccgatatggactgtatcgcccagcacacccgcttcgtcaccagtaccaccgccgccggcgaccctgcgccccatgctgccatgggcgtcttcgccggcatccgcaccaccgccatggcgcgcctgggcagcgacaacctcgagggcctgcgcgtcgcggtgcagggcctgggcaacgtcggttatgccctggccgagcaactgcacgccgccggtgccgaattgctggtcagcgacattgatcacggcaaggtgcagctggccatggagcaactgggcgcccaccccatcgccaacgacgccttgctcagcaccccctgcgacatcctcgcgccctgcggcgtgggtgctgtcttcaaccgcagcagcgttggtcagctgcgttgcgccgcggtggccggttcggccagcgcccaactgaccaacctggacatcgccgaccagttggaaggccgtggcatcctctacgccccggactacgtgatcaattccggtggcctgatctacgtcgccctcaaacacgccggcacggacttgcctggcatcaccgcgcacctgtcgaacatcggcacgcgcctgaccgaaatcttcgcccacgcccaagccgaaaaacgctccccggcacgggtggccgacgagctggccgaacgcctgctgtacaaatagcccaggcattaaaaaggccctgaatcgatgattcagggcctgttcaattcgggctttactctgccgccgggttcagcaactcggacagcgcgtccggttggctcttgaacgccttggcaaatacatcgcggttcttcgccatgtagatcccggcttcttccacctgctgctcgctcagcgacggcacggctttttgcaacacttctgccagcaattcagcgagttccagcattttgtcatgacggtcagcttcggctttatccatgaacaaacgctccagatctcggctgctgcggtataccacttcgacggccattcaccacctcacatgccttcacgatagttgtcttttgcgactactgtatttatatacagcgaaaaggataagccaaacgttggggtttggatagtaggtttttaatgtagttgggaaatgggggtttgctacaccggaaatttctgacaacttgccggggttgcgctggaattgtccggtggcttaccttcctcgggcgctgcatttgcagcgagtgggcttggcggcccaacaaggaagcgcaacgacccccccctgtaagaatgttggatttttgcattagcattcttctgccatggcgggttgcgcatggacccttcggggtgccggggtgttccttgccggtccgccaaccttgtgcaatccgtcacccaatctgcttggcggcagccggtgatggtttcttaactaaggaactaggccatgaaaaaacacacacccaaccccccgcctactgagtcggtgctattcagtgtcacacctgaggcagacacagagaccttactcgcaaacgccagcgaaacgctgagcagtgcctgtgagatggccaataagctggcattcgaccttgaaggtccgcagcgaagcctggtcctggcaattcatcagttgattgaaatgggcggtctgctggtcgagcgcgcgctggagcaagtcgcaccaacttgatgctaaggcccgatcgttctcacactcgtgggaacgatccgagcacaattaagtgcctcgtgtcactcggccaccatctcactatcctgcctatggccttgtttctgcatgcagaacaaccgtcacgtccaacccgcattatccggtcgagccgacctaaggaaacaccatcgtgaaaatcaactgggccgaaaggctgcgccagcaagtccatgggctggccgagtccctgggcaatctgtttgtcgagtcgttccactatctggcgctgtttgccatcggagcggtaaccgcctgggcagcggtgatggaatttctggggatgctggagaacgggcacatcaagatcgatgacatcttgctgctgttcatctacctggaattgggcgcgatggtggggatttacttcaagaccaaccacatgcccgtgcgcttcctgatctacgtggcgatcaccgcgctgacgcgcctgctgatctccaacgtgtcacaccacaacccgccggatatcggcatcatctacctgtgcggtggcatcctgctgttggcgtttgccatcctggtggtgcgctacgcgtcgtcggctttcccttcggtgaaggtcgaaggcccgcgtcgcaagggcgaggcgagccttgaaaccgagaagggtgagctttaaagcccgacgctgaacggcaaggcacgggcgggcggttgctgcagaagtttgtggttgtcgccgtccgtcatcagttcgaggatttccacggcgctatggccctgctcgatggcgatgccgaactggatgctctgcaccaagcgtcgcagcctttgcgggtcgttgcgctgttcggcgctgatcatgcgcttggccaccacgccggtttcatccgagagggtgagcatgatgctgccgtccagccgctggatgctcaggttaacgcggtattgggggctgaaggtatcggtgatgatctgaaaagggttgtccatggtgcgttaccgcctgataagaacatgcagtcattgacggccggtgtcgggattagttcgcattgcctgaccatcggccaaagtccgttttcctcgtaagttctacagcaagcctcgtgccgtacaagcgctgaagttttaatgtgggagggggcttgcccccgatagcggtctttcagccaagtatttattggctgacacacagctatcgggggcaagccccctcccacatttgttctgtgtggctattgggggcggtgaactgtttcagggcaacgctgagaaaatgatcgcagacagcgcagtcgggatgctcgggtaggagtgccctaatcagcactccacccagctgaccgccaggccgccccgtgacgtttctttgtatttgtcatgcatgtcggcgccggtatcacgcatggtgcggatcacccggtcgagggaaatgaagtgcttgccgtcgccgcgcagggccatttgcgtggcgttgatcgccttgaccgcggcaatggcgttgcgctcgatgcacggcacttgcactaggccgccaaccgggtcgcaggtcaggccgaggttgtgttccaggccgatttcggcggcgttttccagttgctccggggtggcgccgagtatatcggccagcccggcggccgccatggcgcaggccgaaccgacttcaccctggcaaccgacttcggcgccggagatcgaggcgtttttcttgcagagaatgccgacggcggcagcggccaggaagaaatttactacgtcgtcatcggacgcatcagggttgaacttcatgtagtaatgcagcaccgccgggatgatccccgccgcaccattggtcggcgcggtgaccatgcgcccgccggcggcgttttcttcgttgacggcgagggcgaacaggttgacccactccatcgccgacagggtcgaggtgatgacgttgggtttgccaatttccaacaggctgcggtgcaatttcgccgccctacgtggcacatccaggccaccgggcaggatgccttcatcacgcaggccctgttccacgcattcgcgcatcaccgaccagatatgcaagaggccgctgcggatctcttcgtcgctgcgccacgcgcgttcgttggccatcatcagttcggaaacccgcaggccgtgcttgttgcacagggccagcagttccaccgcgctggaaaaatcatagggcaattgcacatcgctggtcggggcaatgcccgaggcggcctctgcagcttcgatgatgaagccaccgccaaccgagtaataggtttgctcgctcaataagccgtcgtcgccataggcgtgcaaggacatggcgttggggtggtaaggcaggctttcatccaatagcaggaggtcggtttgccagttgaaggcaatttcctgggaacccgcaagcagtaattggccggactcgcgcagctgctggatgcgtgcattgatcgaggtggggtcgaccttatccggccattcgcccatcaggcccatgacacaggcgcggtcggtggcgtggccgatgcccgtggcggacagcgagccgtacaggcgtatctcgacgcggcgggtctggctgagcaactgctggtcgaccaacgcctgggcgaaggttgccgcagcgcgcatcgggccgacggtgtgggagctggaggggccaatgcccactttgaatagatcgaaaacactgatagccatgctaaacccttacaagcaatggagtagaaatcgctgccatgttttgtaggacgagcgcaattagggcgatactgagcctatagatcgacactgaccaacgaattgttctaagacaccctttagcaggactaaaccctatgacccgccccctcaatggccagacctatgtctggttgcatgttttctcctgcgctgcacggcacctgtcgttcacccgctgcgccgaagaactgcacatcacaccaggtgcggtgagccagcagattcgccagctggaggaacgcctggggtttcggttgtttcatcggcgtgcgcgcggggtggagctcagcgccgaggggcagcgcctggcggccgtggtgggggaggcctatggcagcattgatgcggaattgcggcgcctggacgcgggaatgatcagcggcaccttacgcttgcgttcgatcccgtcgtttctcggcaagtggctgaccccgcgcctgccgcgtttgcagcagcgttttccggatattcaattgcgcctggtcgccgaggacagcagcatcgccttgcatgaaggtgatttcgaccttgctattgacctgaacgacggcagctacccgggcttgttatccacagccctgctggacgagcagatattcccggtatgcgcgcccagcttgttgcgtggccggccaccgttgcacggcccggctgacctcgcgcacttcccactgctacacgacatcaccgcctggcgtgggagttatgaatatgccgagtgggagttttacctgaatgccatcggctatcacagtgcggatgtgcggcgcgggcataccttcaatcgcaatcacttgaccatcgaagccgccattgccggcatgggcgtggcaattgcgcggcgcaccttgctcaatgatgaactggagcgcggcaccctgatcgtgccattcggcgtggccgtgcccaaccataaacgctacgtgctgctgtacgcgccaggtgcgttgaaccatccgggcgtgcgtgcggtgcatgattggctggtagaggaagcaggggtttttcgcgttttgcaccctttggcagaggcgcaattatgagattggttggtcgtaagaagatgtaactaactccccaccctaccagcgtttttgcccgtcgtcagggttaatttgtaatgtaggatttatctttgcaaaggggttgaattgtttcagcaggtgctcaattgtgtaatcaggaggtcatggtttcaccaccccggtgttgcagtttgtgacctctggcgagctagctgaaataagggaagaactatgcaaatccaagtcaatagcgataaccatattgaaagcagcatccgactggaggagtgggtacgtactaccattgagagcacgctcgaacgttatgaagaagacctgacccgtgttgaggtctacctgcgggatgagaacggcgacaagcccggtccccatgatttaagttgccgcctggaagcacggccaaagggccatcaaccggtttccgtgtgccataaagccgatacgctggaacaagcgatcgatggcgccgccaccaagctggaccatgcgttggaacacctgtttggcaaactgcaaggcaagcctcgcgctgctgcgaaaacccagccaatcaacaaagtgaatgaagacgcgcttgaagaggaattcctggaaaacgaaaacgctgcaatcaacggctgaccgttttttaaacccccactgaaaacgggcctgcatatgcaggcccgttttcgttcagccacggagcctgaagaaataccggctcagcgcggctaatccgcaagcccccaagcccgcaaagagcatggcccaaccggcgccggtgcgcagtgccgtctgctcatcaacggcggtcagccccggcgcgttcagcttgcctgctgcaatatgctggctgagcgctgcccactccaatgccgtgttgtcaggcagcacattggccaggtggtggctgatccccagcaacagcaccaggcccatcaacgcaatgttgagtgccagggtgatcagtcgtgcgctgaagtcgatgcccgacgccatgcccgcacggtcagccgagacggccccggtagtggtgttggtggtgggcgagttggtcaacgccaggccaatgccggcgatcacgcaactgagcaacaccagtgcggtgcttggctgtgcggcgacattgacggcggccatggccaggaaccccgcgcccatcgtacccaggcccaggggaatgatgcgttcggcgccgaaacgcagggccaggcgttcggccaggggcggcaccagcagggtaggcaaggtgtaggcaagcagggcggcgccagtggtcagggtgtcgtaacccaaaccggcctggaaatacaacggcaggtaaatcatgaacggccagaagctgaagttcatgccgatcgagcccatcaacgcaccgttgaagcgctggatacggaataccgagaaatcgaacatcgggtgtgggctgcgcagttcgagcaaaatgaacagcagcatgcctatcaaggacaggccggcccagccgagcatcgccggggtgccaaagccatactcgctgccctgggtgatgaaatagaccagcgcgaacaccgtcatcgtcaaggtcagcataccggcgatgtccaggcgatgactggccgggtcacgggattcctgcacgctggcatgcagcagcaccaaagtgaacagggtcagcggtacgtggaccaggaacacccagcgccagtccgccacggccaggattaatgccccgaccatcggcccgaaacccaggcccacgccggcaatcactccccatatcgcgaaggctcgcgctcgcgccgccggctcgcggaactgatgggacaggatggcgaactggcaaatcatcatcgccccggcaccaatgccttggacgaaccgcgccacgatcagggtcgacgcattgtccgccagcccacaggccagcgaggccaggccgaacagccacaggcacagcaccagtacgcgccgacggccgaagcgatcggccaaggtacccgccgccatcagcacactggtgcaagccagggtataggcattcatgatccattgggcgtcctggaaaccggtgcctagttgctgttcaagggtcggcaggatgaccggcacgctggagatttccaggccgaacatcagggctaccaggcagacggcggtgagggccaagccatttctggtggtgcttggcgggtggagggccgatacagcagcggcgggcggcatgacaggttccttttgaataggggagggttctattctctcgggaaccagattcgttatttgtgataagttttccattaataagggaatcacaggcgacaattgactcatggccaccccgcgttttgatggcgtcgagctgtttctgcaaattgtcgagagcggtaacctcaccgacgccgccgagcgcctgaacctcacgcgctcggccgtcggtaaaggcttggcgcgcctggaggcgcggcttggcacatgtctgctgcagcgctccacgcgccgccaacgattgaccgaggacgggcaggcgtactacgagcattgcctgcgcgccttggccgaactggaagccgccgaatcggtgctcgaaagtggtcggcaacaaccacgcgggcggttacgggcgagcgtgccgttggctttcgggcaccactatgcggctccggcgttgtggggcttgatggagcgttaccctgaactggaaatcgagatttgcttctccgaccgcatgattgatctggcacaggagggcttcgatatggccgtgcggatcggcacgttgccggataccgaccgcctgagtgcacgccgcctgggacagcaggtcatggggctggcggcgtcaccggcgtatctgcagcgcagggggagcattgaaagtatcgaagacctaaccgttcatcgcggcatcgcgtatcgcagcaacaccacgcatcgctcgcacctggcctcgctgttggtgctggatgatctccaagcggtagccgatgcggtcatcgcgggcgtagggctggcctggttaccgagttggttgatcgcccactatgcgttgcgcgggcaattgcaggcagtgttgccaagctatcgcgagcagccggcgcctatccatgtagtctggccgacggcggtgcatatgccggccaagacgcggtgtgccatcgatgcgttggtggcgggtacgcccagttgcctggcgggtagctagaccctcggatgtacttcaatcctggacacactgaatatcaaatgtgggagggggcttgctcccgattgcggtgggtcagctatacataggctgactgatctactgctatcgggagcaagccccctcccacattttttgcagtcgtcaatttgaaggcaggctgtcagaacgcaatggacgtctgcacatacaccgtacgcggctcacccacgtacttgcccttgttgttatcgtcgaacgagcgggtgtagtactgcttgttgaagatgttcttcacccccaccgccacattcaaatccgacagttgcgggccgaagtcataggccgcacggctgctgaacagcatgtagccggggatgcgcccattggcaccgtcggcgctttcggcctgggtgttggcattgtcggcaaactggctgctctggtagctgctgtccacattcagcttccacgggccgtcggtgtaacccacaccgagagtgcctttgtgcttggacgagaagggcacgcggttgcctttgttcgggccgtcttcgcggatggtcgcgtcaacataggcataagtggcatacacatcgaaacccgccagcgccgggctcaggccgtcgagggcgtagttgatgctcgactcgatgccctggtggcgcgtctcaccacgggcgatcaccgtgtcgttggtctggttgctgtcgtactggttgtcaaagttgatcaggaacgcgccgatttcagcacgcagcgtgccgttgtcatagcgcgtgccgagctcccaggtgcgggctttttccggtttgacttcgccgctgttcacgcggttgggcatctggctgtactgcacgctgccgaatgagccttcggtgttggcgtagaggttccagtcgtcggtgaggtggtagagcacgttcagcgccggcagcgcggtgttgtagtcacccttgtatttgacgttgctcaggttgttggtctgctgggactcgatcatctcgtagcggatgcccggggtgatggtccacttgccgatatcaatgcggtcgtcgatgaagaacgcattggcttcggtgccaccgcgcgtgtcgcggtcgttgcggctgtcggtggtggggatttgctgattggcggcgattggcgtgcggtagcgcagttcgtggccggcttcattgatgtagcggtagccgacgcccacttcatggctcgtggggccgaggtcgaaaccctgggcgaatcgggtctcgaggccgcgtacccaatattcgcgtggcgacagcgacaggaagctgccctggtccagataaccgctgcgcagggtcttggtgaagaagctgttgaccgtgaattcgcgacggtcctgctcgtagcgatagccgacgttgaacatggtacggcggccccagaacttgtcgtaggggcgggtggactggtatggatcggctttgtaatccttgacgttcaagccgccgggcatgtcggcctggccttcgtagtattgcgccatggcgttgaagctgttggcgtcgtccagttggtatttgcccttgaggatcaggtcgtcgatacgcgtgttgctgttttcgcgccagtcgccgccccgagtacccgagtacagcagcgcgccgcccaggccattgtcggcagtgccgccggccagtaggttgccggtggtcttgaagccatcgtggctggaagacgggctggtctcggtctgcaacccgcccttgaccgtgggcgcatccgggatagcgcgggttacgaagttgacgatgccaccgacgttctgcgggccgtagcgcaccgcaccgccgccgcgtaccacatccaccgcgtccatgttgcccatgctgatcggcgcaaaggacaactgtggctggccgtagggcgcaaaaggcaccgggatgccatccatcaacaccgtggagcgcgacgccaggcgcgggttgagcccgcgaatgccgaagttcaacgccatgtcgtggctgccggtgccgttgttttccggggcattgacgccggggatgcggttgagcacatcgcgggcctgggttgcgccttggcgttcaaactcttcacggcggataacgtcacgggcgccggggtgttcgaacacgttggtttgcgctgcgtcaccgagccagtcgccgaccacgttggaggtttgcaattcaaggggggcggtgacgccggtcggttgcaggctgtaggcattgtcaccttcggcccgggcttgcaggccggtgccttccagtaatttctgcaggccgtcggcggcgctgtaattgcccgacaggccgcggctttgcatgccggccgtcacttcggaaccgaaagacaccagcaccccggcttcgcgaccaaattgattcagggccgcttccagggtggtcggcgcgatgtggtaggtcttggtgtcggcagccatcgcggggggaaggacggtcaggctgaggctggcgcccaataggagttggcgcaaggtgcgggcgagaagcgtcggttgctggggcatgaaggcggtcctgagaaggaaggatcaaggtggctttccttctctgtcacgccaggtgcggaaaacggctcacttaaacgcaaaataaattcaggcacgtgcctgcacggtcacccaatagcgggtaaagcgccgcactttcaccggcaggctgacttccagcaggtcgaggatgcgttcgctgtcatccagcgggtagctgccggacagcagcaggttcgccacttgcgggtcgcaatgcagctggccgcggcgataacgccccagttcgctgagaaagtcttccaggcgcatatgcgcggccaccagcataccgtcggcccaggcgccgctgttggcgtcggtcgggcgcggggtgtcccagcctttgcgggtgaaattcatctggtgcccggccgctacgttcagtggcaagccaccgtaattattgggcgtgacctcgacctgaccagccagcactgcgagttgggtatggtcgttgaactggcgcacattcaggcgcgccgcctggctgctgagcaggccctggccggtcagcacgcgcaacggcgtatcgcctgcatgggcggtcagcagaatttcgccttcgagcaggcggatcagccgttgctgcccatcgatatgcacatccactgcgctgcccgtgttgagtttcaactggctgccatcggccagttgcacggtgcgacgctggcccaccgggctgcgatagtcggcgctcagcggtggcaggatatgttgctggcgcaggctccaaactgctgccgaaccggcgcccaggatcagcagcaacttcagcgcctggcgccggctgcgcaaggtgggggcattcaacgccgcgtgggccaggggcgagggcatgccgcgcaggcgttgattgacctgctggatctgttcccaggcgcgctggtgctcgctatgggcattcagccattgttgccaggctgcttgctggcgtggagtgagcgcgccttgctgcatttccagcagccagtgcacggcttgttcggcgacttggctggagacgttcataacgcgaagtaacagcgcatggccgctttggtcaggtggcgcttgacggtggcgatggagatgcccagttcagcgctgatctgcgcgtaggtcaggccatcgagctgggcgagcaggaaggcccgcttgaccagcctgggcaagccatcgagcagttggtccagctccagcagggtttgcaggatgattgcgcggtcttcttccgacggtgcgacgtgctcgggcatttgcgccaaggcatcgaggtaggcgcgctccaggtcctggcggcgatagaagttgaacaatacgcgcttggccacggtggtgaggaaggcgcggggttcgatcagggtcggggtgtcccttgcgctgagcacgcggatgaaggtgtcctgcgccaggtcggcggcgttttccgggcagccgagcttgcgtcgcaaccagccggtgagccagtggtgatggtcgttgtacagaacttcgacggtattggacggctgcaacgcgatcactccgtaagcatcgccatgctttagagaacaagaattgttcgcattgtaggggcggcgacgaggttcggcaatccgtcacggcaggtgattcatccgttctcttttgcttatgagaatatttatcattaatattgcgcgctgatcagcttggcgtctgccgcatgaaaagcaaaacctcattgcccgtttcctaccgcctcgccgtcacctcgcgtgggctggcggctgttatcggcggctacctgatggcatccctggccgccatctgcctggcgttgtggatgcccacatcgcgtgccgacgcggtggtcaccggcatgatgagctcgtttgtgttctacctgctggcggtgctctggtgctttgcctgccgcactgcgtggcgtgcctgggcgggggtgatgctgccaagcgcactgtttgccaccctggccggcgtaggtttgtggatggtgcgcacatgaaggagggttttcgccaagccatggcctggctgcatacctgggccgggttgatcttcggctggctgctgttcgcgattttcctgaccggcaccctggcctatttcaaagacgaaatcacccactggatgcagcccgaagtgcaggcccatcccctggatgacgggcgcagccttgccgtggcccaaagctacctgcaacaacaggcgccgactgcggcgagctggttcatcagcttgccgaccagtcgcgacccaggcttgtcggtgatgtggcaagacaaggccgagccgggcaagcgcggcaccttcatccagaaaatcctcgacccggtcagcggccaaccggtgcaggcccgcgacagcaagggcggcgagttcttctatcgtttccacttccaactgcaaatgccttacccatggggacgctggctgtcgaccatcgccgccatggtgatgtttgtcgcgctgatcaccggcatcatcacccacaagaaaatcttcaaggacttcttcaccttccgcccgcgcaaaggccagcgttcctggctggacgggcacaacgcggtgggcgtgctggtgctgccatttcatctgatgattacctacagcagcctggtgattttcatgagcatggtgatgccggcgccgatcatggcgtcctatggcgacgacagcctggcattcttcaaggagctgtttcccaacaccgacaacccgccggccctcggccaaccgggccagttgctgccgttattgccgatgtaccagcaggcgcggcagcagtgggcgggcggccatgtgggacgggtggcagtcaacaaccctggggatgtgaacgcgtcggtcaacgtgttccgcgccggctccgatagcgtggtgcatgatttcggcaataccgtgtcgttcaatggcaccaccggcgagttgttgcgggttagtggcgagccgtccctgccggcggtcgtcggtggcagtttctacggcctgcacatgggccattttgccggcccggtactgcgctggctgtactttatctgcgggttggcgggcacggcgatgatcggcacagggctggtgatctggctcggcaagcgtcagctcaagcacgccaagagcgcagtgatgccgtttgaattgcgcctggtagaggtgctgaatatcgccagcatgtctggcttgatgatcgccatcgccgcgtttttctgggccaaccgcctgttgccggtaagtttcgccgcgcgctctgactgggaggtgcaagccttctttgtcgcctggggcctgagtttgttgcacgcgatgctgcgtcgcggtcgtcgaggctgggtcgaacaactgagcatcggcgcgctgctgtttgtggcgatcccgctgcttaacgcaatgaccaccacgcagcatttgggcgtctcgctgatgaacggcgactgggccatggccggcttcgacctgacctgcctggccagcggtgtgttccttgcctgggcggcgtggaagatgcaacgccgtaccgcgtcgcaacccaaagccgaacgtgcgcgtgggttgacgctcaagcaggaggccggctgatgctcctcgcgctgctgatgtgctacgccgggtttaccgcgctgtgcctgtccaccgaccgtcatcacggcgagctgctgcacagcaaactcacgtcgaagcggcgcttggggctgcggctgggtggctggttgctgctgattgccgcgatctggccggcggtgctggccgcaggctggagccagggcctggtcgagtggtgcgcagtgttgatgctcagcgccttgttgctggtactgctgttgccatatcggccaaggctggcgctgattctggcaggcctcagcctgctggccagccctgtcgcggcactagccctgtcctgagcctgccatgatgatcagcccaccgccggaaccccaggaccgcccgcaccccgatgcggccggtgggcgcgcgcatttcctgcaggtgtttttgtcccagcgttcgcagatggaagcgctggtcagtcgccgtgtcgggtgccgcgccacggcagccgacctggtgcaggatttgttcctgcgcttctggcgtcgccccttggtgcaggttgaagaactcagcacctacctgctgcgctgcgccagcaatatcgccatcgatcacctgcgtagcgaaggtgcacgagtacgcagcagcgaaggctggttgcccgagcaatcagatcaccaagtctgcgaaccccaggccgcactggaggcaggccacgatctgcgccacgtggaaaccgccctgcgcaatttgcccgagcgtacccgccagattttcctgcttaaccgtatccacgggcgcaagtatgcagaaattgccaaggccatggggctgtcccaaagtgccgtggaaaaacatatgatgcgcgccctcgaagcctgcaaggccagccttcgtgaaccaacgcagccacgcacgccagggaaagcaccgtgaacatcacgccgacacccgcccaggaacagtccgcccttgactggctcagcctgctgcatgaccagcccagcagcggcgaccaggctacgttcagccgctggctgcgcgctgatcccgcgcatgccgaggcgtacgcccaggctcaggtactgtgggaactgagcgaagagccggcgcgcaagctggccgatgaggacgcgctggccttgcaggcctacctcaataagatgaattcctccaggcgctcccgtgcactgcgctggcccggcgccctggccatggccgcctgcctgctggcgatggtgtcgatgggcgccggttggcagccgtcgcgctgggtcgatgagttgggtgctgactacgtgacggcgccgggggaggtgaagaccttcaccctgaccgatcaatccgtggtcacccttgacgccgacagcgccattgccgtggatttcagccatggtcaacggcatatccagctgcggcgtggcgcgggattcttcagcgtggcacacaccggccagtcctttgtggtggaggcgggcggtggtcaagcgcaggtgctgggcacccagtttgaggtgcgcctgcaaccggccggagccgaggttaccgtattgtccggccgggtgggcgtcacaccatcggaacagggccagcagcaggttttgacagcaggtcagcaagtggcctacgccgatggcgttgccgatgccatgcacgctgtcgacagcgaatcccgcctggcctggcgcgatggttggcttaactactaccaggcgccgctggccgatgtggtccaggacttgagtcgttattaccctggccgattgcttctgctcaatgaagagatgggcgccaaacgcgtcagcggcagtttcccgagcaacgacccgttggcggtattgaacgccttgcaagcggtgctgggctttgaacaacacaggctgctgggtcgcatcatcgtgttgcgctagacgcagcgccgttcaccgaaccttcatcgcaatcgctaaaacctgtcaccaaacggttacacgtgccgtggatcatccctgggttcctgagcaagtggtcaagaagagcacctctgccccatacaacacaacaatgtcagtaagggatctacacgtgaactacaactctctttatgccctgcttctggcatcgggcctgggcggctttgcaccgctggttatggctgatgacacccaggacgtaggttcggtgaacgttgccggcaagcagaccctgggcaacggccacatgattcgcgaagaaagtgccaaggcgcgctcgacggtgaccaaggaggccatggacgaaatgtcggccaccgccaacgccatcgacaagctcaaatacacgccgggcatcaacgtttccagcgatgacgccagcggcaccagcggcaccaacttcactatgcgcggcatgagttcggaccaggtcggggtgtcggtggacggcgtgccgatcaacgattctggcaactacagcgtgtattccaaccagttgggcgacccggaaaaccttgccgaagtgttcgccacccagggctcctccgaggccgacggcccgcacatcggttccagcggcggcaacatcggcatgattacgatgcggccaaccaaggaggcgggggtttttgccaagcagaccttgggtaccaataacctgcgcaagaccttcgttcgggcgaataccggcgatttcggtggtctcaagacctgggtctcggcatcgcacctggaaggtgacaagtggcgcggcaagggtaccctgcgcagcgataaaatcgagtggagcagcctgttcgaaggtgacaacggcaattccacgttggccacggtcaagtacaacaagcaggaaaattacaactacaacagcctgagcaagtcgcagttcgacaatgaaggacggcgcaaggactacgctgaaagcccggtgtacaaggccggtttgttgtctgcgtcctacaagctcaaccgcaacccctttgaaagcgtcaacgccacgctgacccagcgctggcaactgcaagacaacctgtcgttgacggtcacgccgtattactactggtccaacggtggcagcttcagcggccagactgcctccaacctggggccgagatccgacaaagccggtaactacgacctcggcaacctgcaatcggccaactactatcgcccttcgtggaccgagacctggcgccccggcgtcacggccaaaatgaagtgggacatcaacgaagaacacagcctggactacggctactggtatgaacgcgcacgccagcgccagacccagccgtttatcggcattaacggcgagggcgcgccggatgatgtgtggggcgactacaacagcggcggccaggtggtcgacaagaacggtgcgacggtacaaggtcgtcattactacaccgtcaccccatcgcagaagctctgggtacaggacagttggcaagccacgccggacctgagttttgtcggcggcgtggcctaccaatacgtcgaacgtgacggcaacaacctcggcagcctgtacgacaagccggaaaaacgtaacacccgttaccaccaattcctgcccagcttcagcgccaagtaccaggtcgacgagagcaaccaggcgttctacaacgtcacccgcaacatgcgcacgccgcccaactatgtgctgtacaacaaaggcgactccgtcagcctcaagtccgagttgagctggaaccaggaactgggctggcgctacaccgaagacgacatggccttgagcgcgaccctgttctacatcagcttcaaggatcgccaggtgtcgaccaccgatgccagtggcgactacatggtgctcaacgttggcagcgtcgctaacaaaggcctggaattggaatggagtggtttgttgccccacaacttcaactactacgcctcgtacacctacacccagtccgagcagaaggacgacctgctcagcaagaatgtgctgttgcccacctctggcaagcaactggccaacgtaccggaaaatatgttcaacctggtgttcggctatgacgactcgcggttctacggcaacgtggcgggcaagtatgtcggcagcttctacggtgatttgaccaacaaggagaagatcgaaggccgtacggtgtttgacctcaatgccggtatctatttgccggtggacaagaaggtcatcaagtcggcgaccctgcgcttgtcgatgctcaacgtcttcgacaaggaatacctcagctcggcccgcaccgtggcgttcaactcgacaccggtcaacggcctggcgccgagcacggcgtattacaacgtaggggaggagcgcacggcgatggtgtctctagaggccaacttctaagaccaccacaaaaccaaatgtgggagggggcaagtcgaatcgtcgcaccgcccctcccacatttgatccacggtgtttcaggagctgggttatttcagggccgccatgatcgcatccgggtcgtagtcgcggatcagtgtgccattgacgtccacaaatggaattccgccaccacccaacgcctcataggccttgcgcgcctgggcgtccttctcgatatccagcgcctggtacgggatacccttctggtccagaaaacgtcggatctgcttgcagtatccgcaccactgcgtggaatacagcaccacacgtgccgaggcgcgtacctgctccgaaaccacctgggacgggttgaacagccgctcgaccttgccccagttctggatcaccaccaccaccagcaataccagcaggactttcttgaagaccccgcccagcatcaattacggcgcttgagctggtcggtcagttgggtcggcaggcccttgatgatcaaggtgccggcagcttcgtcgtactcgatcttgtcgcccagcaggtgtgcttcaaagctgatggacaagccctcggcgcgcccggtgaaacggcggaactggttgagtgtgcgtttgtccgccgggatttccggcgacaggccgtagtccttgttgcggatatggtcgtagaaggcttttggccgatcttcatcgatcaagccggaaagttcttccaggcccatgggctcgccgagcttggcctggctgctggcgtagtccaccagggtcttggtcttttcacgggcggattcgtcaggcaggtcttcgctttcgacgaagtcgctgaacgccttgagcagggtgcgggtttcgcccgggccgtcgacgccttcctggcagccgataaagtcgcggaagtactccgagaccttcttgccgttcttgcctttgataaaggagatgtattgcttggactgcttgttgttctgccactcggagacgttgatgcgtgctgccaggtgcaactggcccaggtccaggtgacgcgagggggtcacgtccagctcgtcggtcaccgccacgccttcgctgtggtgcagcagggcgatcgccaggtagtcggtcatgccttgctggtagtgggcaaatagcacgtggccgccggtggagaggttggattcctccatcagcttctgcagatgctccacggcggtacggctgaaagtggtgaaatcctggccaccgtcaaagtattccttcaaccagccgctgaacgggtgcgcgccggactcggcatggaagaaaccccaggccttgccttgtttggcgttgtagctctcgttgaggtcggcaagcatgttctcgatggcggccgactcggacagctcggagtcgcgggcgtggagaactgcgggtgtgccgtcgggttttttgtcgatcaggtggacgatgcaatgacggatcggcataggcttctcggctggttgaagggggagcggttggcctccccgaaaagtcgcccagtgtaccgcacccattggtcaagacgtgccccgaagggcattttgcccttctccgaccggccatatgcctttttttcacggtttagagcgataaagctgaccaaatgggtatgttgaggcggatatttccccgtctctgtgctagttttgcccggtcttacgccaagtctcggcgttaagcgtgcattcagcatttgtcaggtcgaaccaatccccgtttcaagcatctataaccccgatctccgtggttatggccggggatgccaggccatgacggtcgggctcgacggctgacactgcactctgcaatccatatgaatttgatagggaaggaacaccacaatggctttgactaaagaccaactgatcgctgatatcgctgaagctatcgacgcgccaaaaaccaccgcgcgtgctgctctggaccaactgggccagatcgttgctgatcagctggaaaacggcggcgaaatcactctgccaggcattggcaagctgaaagtgaccgagcgtcctgcccgtactggccgtaacccttcgactggcgctgccatcgaaatcgctgccaagaaagttatcaagctggttgtggctaaaggcctgaccgacgctgttaacaagtaagaagcagtaaaaaaaaccgtgcttcggagtgatccgggcacggttttttgttgcctgcggtttttctaactaactgtaggagcgagcttgctcgcgaaagacgttaacgataacgcgtccgttctggttgaacgcggcgccttggtgttttttcgcgagcaagctcgctcctacaggtgggctagcggacccagcgctggcgccagatctgctgctcattcttggtctggaacgtccacgccacaaaccggctttgcttctgcccctgagacatctccaccacctggctttccagcacgccggcttttttcagcgcggtctggatcgcgggcaggtttgacgcttttgacaccagggtgctgaaccacaacaccttgtgggcaaaatgcgcactctcggcgatcaactgcgtcacaaagcgtgcttcgccgccttcacaccacagctcggccgattggccaccgaagttgaggaccggcaacttgcgtttcggatcggccttgcccagggcacgccacttgcgctcgctacccttggtggcttcgtccatggacgcatggaacggcgggttgcacatggtcaggtcaaagcgctcgcccggctccagcaagcccagcaggatctgcttggggttgggctgttggcgcagctggatgaccttgcccaggtcattggactgcacgatggccttggcggcggcgacggctatagggtcgacttccgagcccaggaagttccagcgatactccatatagccaatcagcgggtagacgcagttggcgcccatgccgatgtccagcaccttgacgatggagccgcgcgggatcttaccgtcgttgacgctggccagcaggtcggcgagaaaatgcacatagtcggcacgccccggcaccggcgggcacaggtaatcggccgggatgtcccaatgctcgatgccatagaacgacttgagcaaggcccggttgaatacccgcaccgcgtccgggctggcaaagtcgatgctttccttgccatagggattgatgatcacgaattgcgccagctctggcgtggtcttgatcagcgccgggaaatcgtaacggcctgtgtgacggttgcgcgggtgcagggtggcctctttgcgcggaaccacgggcttggccggggtagcggatttaggcttcttgcgcgggggtttaggcgtagtgggggcggtcatgttgattctggtgttggctcaaagtggcggccattgtcacacattcccgaggacaactcggtcaaatgtgggagggggcttgctcccgatagcggtgtgacagtcaagaatattgagactgatccaccgctatcgggagcaagccccctcccacagaggcaaaaaaagagacccggaggtctcttttttcacgcgaattgaaccttacaggctggagatccgcgcatgttgctcggccagcttgcccaaagcctgttcagcttcggccaacttggcgcgttctttgtcgatcacttctgccggtgccttgtcgacgaacgccgcgttggacagcttgccgcccacgcgttgcacttcgccttgcaggcgggcgatttccttgtcgagacgggccagttccgcgcccttgtcgatcagaccggccatcggcaccagcacttccatgtcgccgaccaacgcagtggcggacagcggcgcttcggcatcggcagccaatacggtgatcgactccagcttcgccagcttcttaagcagcgcgtcgttctcgctgaggcgacgctgatcttcagcgctggcgttcttcacgaacaccgccagtggcttgcccggcccgatgttcatttcggcgcggatgttgcgcgtgccgagcatcagggtcttgagccactcgatatcgctttcggcggccgcatcgatgcgcgcttcattggccaccggccaaggttgcagcatgatggtcttgccttcgataccggccagcggcgccaggcgctgccagatttcttcggtgatgaacggcatgaacggatgcgccaggcgcaacgccacttccaatacgcgcaccagggtgcgacgggtgccgcgctggcgttcgaccggggcgttttcgtcccacaataccggcttggacagttccaggtaccagtcgcaatactggttccagatgaactcgtacagggcctgtgcggccaggtcgaaacggaactggtcgagctggcgggtcacttcggcttcggtgcgctgcaactgcgagatgatccagcgatctgccaggctcaactcataggcttcgccgttctggccgcagtcttcgcctttatccagcacgtagcgcgcagcgttccagatcttgttgcagaagttgcgatagccttcgacgcggcccatgtcgaacttgatgtcgcgaccggtagaggccagcgagcagaaggtgaagcgcagggcgtcggtgccgtagctggcgatgccgtcggcgaattcgtcgcgggtctgcttctcgatctttttcgccaacttcggctgcatcaggcccgaggtgcgtttctgtaccagggtttccaggtcgatgccgtcgatgatgtccaatgggtccaggacgttgcccttggacttggacatcttctggccctggccgtcgcgtaccaggccgtgcacgtacacggtcttgaacggtacctgcggggtgccgtcttcgttcttcaccaaatgcatggtgagcatgatcatccgggcaacccagaagaaaatgatatcgaaaccggtgaccagcacgtcggttgagtggaatttcttcaggaactcggtctgctgcggccagcccagggtggagaaagtccacaggcccgagctgaaccaggtgtcgagtacgtcgttgtcctgttgcagcacaacatccgcgcccaggttgtgcttggcacgcacttcggcttcgtcgcggccaacgtagaccttgcccgactcgtcgtaccacgccgggatgcggtggccccaccacagctggcggctgatgcaccagtcctggatgtcgcgcatccacgagaagtacatattttcgtactgcttgggcacgaactggatacggccatcttccacggcggcaatcgcaggctcagccagcggcttggtggacacgtaccactggtcggtcagccacggctcgatcacggtgccggagcggtcgcccttcggcactttcaggccatggtcgtcaacgctgaccagcaacccggcagcgtcgaacgcggcaacgatctgcttgcgcgcttcgaagcggtcgagaccggcgtattcggccgggattttgccgtcgatgctgtcgttcaacgtaccgtccaggttgaacacctggcaggccggcaacacggcggcattcttgtcgaagatgttcagcagcggcaggttgtgacgcttgccgacttcatagtcgttgaaatcgtgggccggagtgattttcacgcagccggtgccgaattcagggtcgcagtagtcgtcggcgataatcgggatgcgacggccaaccagcggcagttcgacgaacttgccgatcagcgcctggtagcgctcgtcgttcgggttcaccgcgacggcggcgtcgccgagcatggtttccggacgagtagtggcgacgatcaggtagtcgttgccttcagcggtcttggcgccgtcggccagcgggtacttgaggttccacaggaagcctttttcgtcgtggttttccacttcgaggtcggaaatcgccgtgtgcaacttggtgtcccagttgaccaggcgcttgccgcggtagatcaggccgtcttcatgcaggcgcacgaaagcctctttaacggcttccgacaggccgtcgtccatggtgaagcgctcgcggctccagtctacggacgaacccaggcgacggatctgacggctgatattgccgccggactggtctttccattcccagatcttttccaggaatttctcgcggcccaggtcgtgacggctctggccggtggcttcgagttgacgttccaccagcatctgggtggcgataccggcgtggtcggtgcccggttgccacagggtattgcggccctgcatgcggcggaaacggatcaacgcatccatgatcgcattgttgaagccatggcccatgtgcaggctgccagtgacgttcggtggcggaatcatgatggtgtaggagtcgccggcaccttgtggggcgaaatagttttcggactcccaggtgttgtaccaggaagtttcgatagcgtggggctggtaggtcttatccatgcgcggcgggaccctagttggcatttattcaggaaagccggcaagtataacggggcaggacgaggagggcgagttgaagacggacttaaggctgatgcaaaactaatgtgggagggggcttgctcccgattgctgagtgtcagccaccgaatcatcggctgatacaccgctatcgggagcaagcccctcccacaggaaatatcagtgtggtttaggactggtactggctgagcaaccgttccatgcgcgcatccatccgccgcttgatctcagcttcaatatgcggggcaaagtcgtcgatcacatcctgcatgatcagttgcgcggcggcgcgtagttcgttgtccaggtgcagcagcagggcatcgggagctttttctgcggccggagcgggttcggcaaccacaggttccggtgcggcaggcttgccgccgaccatatcgaacagcagcggaatctgtacctcgccatcgaccgtgtcggtcagcagcggcggctgcaggttgtcatcacccagcaactggcggatcgactcaaggtcgtccagcaggtggtcgtcttttttcagcgggttgggagtgtccatcgtgtactcagagtcgttgtagccggtgatcctgcaaagaatagccctgttcgcggtagaaacgaaaattctcccgcgcggcctgacgaatagccgggtcttccaccaccacttccgccacgcgggcaaacgtcttggcaaaggccggtactttcaggtcgaggttgaccagcaggtcctggtgatcgccgcaactgtcccctaaacccaggacaaccaggctttcaggttcggattcggcggggccgtggggcacgaagctttcgcccttgaagcgccacaggcgggcatccagttcgtcacgttgggctgcatcgctgcaatgcaggtagatgcggtggcccatgcgccaggctttttcggtgagcttgcaggcaaagtccaggcgcgcgaggggatcggcgctgggcaatatatagaagtcgacttgggtcattgcagttcctggtgctggcccgccagttctgtaggaacgagcttgctcgctcctacagaagggccggtggcgcttaggctttggcgcgatccagcaggtactgggtcagcagcggtactggacgaccagtggcgcccttgtccttgccgccgctggtccaggctgtgccggcgatgtccaggtgcgcccagttgaagtttttggcaaagcgcgacaggaagcaggccgccgtgatggtgccggctttcggaccaccaatgttggcgatgtcggcgaacgggctgtccagctgttcctggtactcatcgaacagcggcagttgccaggcacggtcatcggcggccttgccggcgctgagcagttgctcgatcagttcgtcgttgttgcccagcaggcccgaggtgtgggagcccagggcaacgatgcaggccccggtcagggtggcgatgtcgatcacggcttgcggcttgaagcgctcggcataggtcagggcatcgcaaagcaccaggcggccttcggcgtcggtgttgaggatttccacggtctggccgctcatggtcgtgacgatatcgcctgggcgggcagcgccgccgctcggcatgttctcggcacacgccaggatgcacaccaggttgaccggcagtttgagttccagcaccgcacgcagggtgccgaacacgctggcggcgccgcccatgtcgtacttcatctcgtccatgccggcgcccggcttgaggctgatgccgccggtgtcgaaagtaatgcctttacccaccagggcgtagggcttctcggacttcttggcgccgttatattgcatcacgatcaggcgtggcggctggtcgctgccctggcccacggcatagaacgagcccatgcccagttccttgatcttcttctcgtcgagcacttcgactttcaggctcttgaactccttgcccagcgccttggcctgttcgccgaggaaggtcgggtggcagatgttcggcggcaggttgcccaggtcgcgggtgaacgacatgcccttggcgatggcctgggcgtgggtcacggcgcgctcgacttcagcctgggcggccttgatggtcagcagggtgatttttttcagggcgcgcggttcggccttctggctcttgaactggtcgaaggtatagccgccgtccaccaggctttcggccagcaggcgggtcttgccatagctgtcacggcccttgatgacgatttcgtcgagtgccagtgccgcatccgtgccaccgaggcccttgagggtggtgaggatgccgctgacaattttgcggaacggacggtcgcccagttcagcatccttgcccacgcccaccagcaagacacgctcggctttaaggttaggcaggctctgcagcagcaggctctggccgactttgccggccaggtcgccgcgcttgagcactgcgctgatagcgccgccgctcagttcgtccagttgcttggcggcgacgccgagtttgcggccttcgccgacagcgaccacgagggtggcggttttcaacgtttcggggctaacgctttttacaaccaattccattttcgggtcccttataaaggtcggtgagcctggcgtttgtacccaggctttaaagcttggcggcgttgtaagccgcccgcgacaaaggccgcagtttgaacctcgccgacggagcctgacaacccttggcgcgtgctttgtgcgtgcgcatgagtaagctccgtgacaggcgcgaccaatcacaggataatgcctcatctttttagccggcccgcgcaaacgggctgactcggtatgcttgcttgtttggccgccttagcctgacaaccctggagtgtctggtttgatcgtcttccgttatctatcccgcgaagtcctgttgaccctgagtgccgtgagtgcggtattgctggtcatcatcatgagtggtcgtttcgtcaagttcctggcccaggccgccgctggcgccctggatccaggttcactgttcctgatcatgggctaccggatgcccggcatgctgcagctgatcctgccgctcgggctgtttctcggcatattgctggcctatggccggctgtacctggaaagtgagatgactgtgttgtcggccaccggcatgagccagcagcgcctgctggccatgaccatggtgccggccgccggcgttgccctggtggtggcctggttgagcatgagcctggcaccccagggggccatgcagttccagctgctgctgaacaagcaggatgcgatgactgagttcgataccctcgagcccgggcgcttccaggcgctcagcgacggttcgcgggtgacctacaccgaaaccatgaccgacgaccgctccaacctcggcggcgtgttcatttcccagaagaacctcggccagaaccagaaagaccgtggcattaccatcctggtggccgatagcgggcgccaggaaatccgtcccgatggcaaccgctacctgatcctggaaaacggctaccgctacgacggcagccctggcctggcggattatcgggcgatcaagtacgacacctatggcgtcatgctgccgaaggccgagatcagtgacgaggtcaccgaccgcgacgcactgcccacctcatcgctgttcggtaacccggaattgcgctccgtcgccgagttgcaatggcgcctgtccctgccgctgctggtgttcatcgtgactctgatggccgtgccgctgtcgcgcgtcaacccgcgccaggggcgcttcctcaagttgctgccggcgatcctgctgtacatggcctacctgaccatcctgatttctgcccgtggttccctggagaagggcaagttgccgccagccctgggcctgtggtgggtacacggggttttcctgatgatcggtctgggactgctctactgggaacctatccgtttgaaaatgaagagccgtcgtggcctgaaggagttggctcgtggctaagcttgatcgttacattggtagcagcgtactgatcgccatcctggcggtattgggcatcatcctcggcctggccttgttgttcgccttcattgatgaagtgggcaacgttaccgacacttacacagtcacggacgtgctgagctacgtggcactgactgcgccgcgtcgtctctacgacatgatgccgatggccgcgctgatcggttgcctgattggcctgggcaccctggccagcaacagcgaactgaccatcatgcgcgccgctggcgtctccattggtcgtatcgtctgggcggtgatgaagccgatgctgctgctgatggcgtgcagcgtactgatcggcgaatacgttgcgcctccggcggaagccaccgcccaggccaaccgcgccctggcccaggggtcgggcgatgcgcaaagcgccaagcacggcctgtggcaccgccagggtgatgagttcatccacatcaatgccgtgcagccaggcggcctgctgatcggggtgacccgctacacgtttgataaagagcggcacatgctgtcctccagctttgccaagcgcgcgcaatacagtgccgagcaatggcaactgagcgatgtcaccaccacttacttccgtaatgtgggccagggcaccaagtccagcaccgaagtgatcaatgtgccgaccgagcaatgggatatcgccctgaagccggaattgctcaatacggtggtcatggttccggaagcactgccgatctccggtttgtggagctatatccattacctcaaggaccagggcctgaacaacggtcgctactggctggcgttctgggtcaaggtgctgcagccggtggtcaccgccgcgctggtgctgatggcgatctcctttattttcgggccattgcgttccgtgaccctgggccaacgggtatttaccggcgtgctggtgggctttaccttccgcatcgcccaggatttgctcgggccctcgagcctggtgttcggtttctcgccgctgtttgcggtgctggtgccgacggccatctgtactctggccgggttctggctgctgcgccgggccggttgacgtcgcgcttatgcacaaaaaatgccccgctcccatgagcggggcatttttgttctggtcaccaaagatgacgcctggcccgagcatcaggtacaattcccggctatttttcagcgggcaatctgcctgcagcctttttgagtgttgatccgtgagtgatttgagtcatatccgcaatttctccatcatcgcccacattgaccatggcaagtcgacgctggccgatcggtttatccagatgtgcggcggccttgccgagcgtgaaatggaagcccaggtcctggactccatggatcttgagcgcgagcgcgggatcaccatcaaggcccacagcgtgacgctgtactacaccgccaaagacggtatcaagtaccagctgaatttcattgacaccccaggccacgtcgacttcacctatgaagtcagccgctccctggccgcctgcgaaggcgcgttgctggtggtggacgcggggcagggcgttgaagcccagtccgtggccaattgctacaccgccatcgagcagggcctggaggtcatgccggtactgaacaagatcgacctgcctcaagccgaccctgatcgcgtcaaggaagaaatcgagaaaatcatcggcattgacgccaccgacgccgtcgagtgcagcgccaagaccggcctgggcgtcgacgaagtgctcgagcgcctggtcaagaccattcccgcgccaaccggcaactacgaagatccgctgcaagcgttgatcatcgactcctggttcgacaactacctgggggttgtctccctggtacgcgtgcgccatggccgtgtgaagaagggcgacaagatcctggtcaagtccaccggcaagatccacctggtggacagcgtcggtgtattcaaccccaagcacaccgccaccactgatctgaaagccggtgaagtaggcttcatcatcgcaggtatcaaggacatccatggtgcgccggtaggtgacaccctgactttgagctctagccccgacgtcgccatgctgccgggcttcaagcgtatccagccgcaggtctacgccggcctgttcccggtcagctccgacgacttcgaagacttccgtgaagccttgcagaagctgacgctcaacgactcgtcgctgcagtacaccccggaaagctccgatgccctgggcttcggcttccgctgcgggttcctgggcatgctgcacatggaaatcatccaggagcgcctcgagcgcgaatacgacctggacctgatcactacggcaccgaccgttatttttgagctggcgctgaaaaccggtgaaacgatttacgtcgacaacccgtccaagcttccagacctgtcttccatcgaagacatgcgcgaaccgatcgtgcgcgccaatatccttgtgccacaggaacacctgggcaatgtgattaccttgtgtatcgaaaagcgtggcgtacagcacgacatgctcttcctcggtacccaggtgcaagtgacctacgacttgccgatgaacgaagtggtcctggacttcttcgaccgtctcaaatccaccagtcgcggctatgcttcgctggattaccatttcgaccgttaccaatcggctaatctggtgaaactggatgtgttgatcaacggcgacaaggtcgatgccctggcactgatcgtgcacaaggacaacgcgcactacaaaggtcgccagttgaccgagaagatgaaagaactgattccgcgccagatgttcgacgtcgcgatccaggccgccattggcgggcagatcattgcgcggacctccgtcaaggctctcagaaagaacgtactggccaaatgctacggcggcgacgtaagccgtaagcgcaagctgcttgagaagcaaaaggccggtaaaaaacgcatgaagcaagtgggcaacgtggaaattccacaagaagccttccttgcggtgctcaggttggatagttaggtcctatgtcactaaatttcccgctgttgctggtcatcgccgttgccgtctgtggtttcctggcgttgctcgatctggtgtttttcgccccgcgtcggcgggcagccatcgcttcctatcagggcagcgtcagccagcccgatgcggtggtggtcgagaagctcaacaaagagcccttgctggttgaatacggcaagtcgttcttcccggtgttgttcatcgtgctggtgctgcgctcgtttcttgtagagccattccagatcccttcggggtcgatgaaaccgaccctggacgtgggtgacttcatcctggtgaacaagttttcctacgggattcgcctgccggtgatcgacaagaaagtcatcccggtcggtgacccgcagcgcggcgatgtgatggtgttccgctacccaagcgaccctaacgtcaactacatcaagcgtgtcgtcggcctgccgggcgacgtggtgcgctacaccagcgacaagcgcctgttgatcaacggtgagtcagtggccgagaagctgctgggcgccgagccaaatacgctgggcagcgccgagctgtaccaggaaaaactcggtacggtagagcacgaaatccgcaaggaaatgagccgctaccgcgcgatgcctgatggcgagtggaaagtgcctgccgggcactatttcatgatgggcgacaaccgcgacaactccaacgacagccgttactgggatgaccccaatattcccaaggacctgctgggcatggtgcccgacgagaatatcgtcggcaaagccttcgcggtctggatgagttggccggagcccaagctcagccacctgccgaacttctcgcgggtcgggctgatcaagtaatacaggcggcgctgtgaacacagcgccgaatgcttttctggggcttggacaattaaccgtccggcctcatgcagcaccaatcaggatgtgaatttgaacattgcgtcaatcgtcgatggccgccggtgccaccaactagatatggataaaccgtgaccgtttctctaagccgtctcgagcgccagctcggctataccttcaaggaccaggaattgatggtccttgccctcacacaccgcagctttgcagggcgcaataacgagcgcctggaattcctcggtgatgccatcctcaatttcgccgccggtgaggcgctgttcgagcgttttccgcaagcgcgcgaaggccagctttcgcgcctgcgggctcgccttgtgaaaggcgagaccctggccgtgctggcccgcggtttcggcttgggcgagtacctgcggctagggtccggtgagttgaaaagcggcggtttccgtcgcgaatcgattctggccgatgccctggaagcattgatcggtgcgatctacctcgatgcaggaatggagacggccaaggagcgcgtggttgcctggctggcatcggaaatcgaaagcctgacactggtcgacaccaacaaagatcccaagacccgcctgcaggaatacctgcagtcccgcggttgcgaactgccacgctacgaagtggtagatatccagggtgagccccattgccgcgtgttcttcgtggaatgtgaaatcaccttattgaacgaaaaaagccgaggtcagggtgtgagccgtcgtattgccgaacaggtagcggccgctgcagcactgattgccctgggcgtggagaatggccatgactgattcaaccgcaacacgctgtggctatgttgccatcgtcggccgcccgaacgtgggcaagtccacgctgctcaaccacatcctcggccagaagctcgcgatcacctcgcgcaagccccagaccacccgccacaacatgctgggcatcaagaccgaaggcaacgtgcaagcggtctacgtcgataccccgggcatgcacaaaggcggcgagaaagccctgaaccgctacatgaacaagaccgcttcggcggcgttgaaagacgtcgacgtggtgatcttcgtggtcgaccgcaccaagtggaccgacgaagaccagatggtcctcgagcgcgtgcagtacgtcaccggcccattgatcgtggcgttgaacaagactgatcgcatcgaagacaaagccgaactgatgccgcacctgagctggctgcaggaacaactgccgaacgcccagatcatgccgatctcggcccagcacggccacaacctcgaagccctggagcgcgtgatcgccggttacctgccggagaacgagcacttcttcccggaagaccagatcaccgaccgcagcagccgcttcctcgccgctgaactggtgcgcgagaaaatcatgcgccagatgggcgccgagctgccgtaccagatcaccgtggaaatcgaagagttcaagcagcagggcaagaccctgcatatccatgcgctgatcctcgtcgaacgtgacggccagaagaaaatcatcattggcgacaagggcgagcgcatcaagcgcatcggcaccgaagcgcgcaaggatatggaattgctgttcgactccaagatcatgcttaacctgtgggtgaaggttaagggcggctggtccgatgacgagcgtgcactgcgctccctgggctatggcgacctgtaaggtctcgaatgcaccacagggctgaaaagtgtgagagggggcttgctcccgatagcggtgggtcagttaaccattaagtgactgacacactgcaatcgggggcaagccccctcccacattgggtttgtgtcgttttcaaaaatgcattccaacagtgagcatccatgtcccaatccccgcctcccagccaactcgcctacgtgctgcacagccgcgcctatcgtgagaccagcgctttggtggacttcctcacgcctcaaggccgcttgcgcgcggtattgcgcagtgcgcgaggcaaggcgggtacgttggcgcggccgttcgtggccctggatgtggagtttcgcggcaagggcgagctgaagaacgtcggccgcctggaaagcgtcggcaccagcgcctggctaaatggggatgcactgttcagcggcctttacctcaatgaactgctgatccgcctgttgcccgccgaagacccgcacccggcggtcttcgatcactacgccgccacgttgctggccctggccgaaggccggcccctggagccgttgctgcgcgccttcgaatggcgcttgctcgacgaccttggctacggcttcgaactgagtaacgacctgcacggcgagcccatcgccgccgatggcatgtaccgcctgcaagtggacgctggcctggagcgtgtgtacctgctgcaaccgggcctgttccagggctccgaactgctggccatgagtgacgcggattggactgcgccgggtgccttgtccgccgccaagcgtttgatgcgccaggccctggccgtgcatctgggcgggcggccgctggtcagtcgcgagttgtttcgaaagccctgacatccccgtgtatgctgtgcaccgattctttcccttttcaggagtgcttccgtgaccaccagcaatcgcattcttcttggcgtcaacatcgaccacgtcgccaccctgcgccaggcccggggcacccgttaccctgacccggtcaaggccgcgctggacgccgaagaagcgggtgccgacggcattaccgtgcacttgcgcgaagatcgccgccacatccaggagcgcgatgtgctgctgctcagggacgtgctgcaaacgcgcatgaacttcgaaatgggcgttaccgaagaaatgatggcgtttgccgagcgcatccgcccggcgcatatctgcctggtgccggaaacccgccaggaactgaccaccgagggcggccttgatgtcgcaggtcaagaagcgcggatcaaggccgcggtggagcggctgtcgaagatcggcagcgaagtgtccttgtttatcgacgccgacgaacgccagatccaagcctcgcgccgtgtcggcgccccggccatcgaactgcacactggccgttacgccgatgccaccaccccgaccgaagtggctgatgagctgcaacgcatcatcgatggcgtgaactgcgggctcaacgaaggcttgatcgtcaacgccggccacggcctgcactaccacaacgtcgaagcggtggccgcgatcaagggcatcaatgagctgaacatcggccatgcgctggtggcccatgcattgttcgttggtttcaaaggcgcagtggccgagatgaaagccctgatcctggctgctgccaagcactaactgcagttccacctgtaggagcgagcttgctcgcgaaaaacctgatagcaacgcgggcagccagacttcccccagcatcgttaacgaccttcgcgagcaagctcgctcctacaggtttctgccgtcattcatctgtgcggcaatgcgaacccttactgtttagccgccgcaggtgtatcgtatctgccctttgcaggccctgcgcctgcggcagatacgtgaggttgttgtgtccccatcgttttcccgtcgacagatcctcggtggccttgccggcctggcagtagtcggtgtgggtgccggcggcgcctaccgctactggctgggcaaggttgccgatgccaacgcaggaagcgactaccaattgattgccgcgcctctggacgtggaactggtgccggggcacaagaccgaggcctgggcattcggcccttcggcgcctggcaccgagctgcgcgtgcgccaaggcgaatggctgcgggtacgcttcatcaaccacctgccggttgccaccaccattcactggcatggcatccgcctgccgctggaaatggacggcgtgccctacgtctcgcagttgccggtactgccgggcgaatacttcgactatcaattccgtgtgcccgatgccggcagctactggtaccacccccacgtgaacagcagcgaagaactcggccgtggcctggtcggcccgctgatcatcgaagagcgtgagcccaccggtttcatctacgagcgcaccctcagcctgaaaagctggcatgtggacgaagagggcgccttcgtcgccttcagcattccccgtgaagcagcgcgtggcggtacggcggggcgcttgtcgacaatcaacggagtgtcccaggcagtcgtcgatctcccagccgggcagattacccgggtgcgcctgctcaacctcgacaacacactgacttatcgtcttaacatccctgacgtcgaagcacagatctacgcgctggatggcaaccccatcgagccgcgcccgttgggcaaggaatactggctgggcccgggcatgcgtatctgcctggcgatcaaggcaccgccggcgggtgaagaactgtcgatccgcaacggccccgtgcgtcttggcacctttcgttcggtggccaataccgacgcgcccactcagtggccaccggcattaccggccaacccgattgccgagccggacctggccaatgccgagaaactcaacttcaatttcgaatgggtcggttcggtgtcggtcaacgtcgacaacggcaagccgccgagcctgtggcagatcaacggccaggcctgggacatcaccgacaagacctgcgccgaccgcccgattgccaagcttgagaagggcaagagctacatcttcgaattgaagaacatgactcagtaccagcacccgattcacttgcacggcatgagcttcaaggtgatcgcttcgaaccgccacaaggtgattccgtatttcaccgacacctacctgctgggcaagaacgaacgcgcccgtgtggcgttggtggcggataacccgggggtgtggatgttccattgccatgtgatcgaccatatggaaaccggcctgatggccgccatcgaggtggtgtgatgcgccaggttcgccccacggcaattatcgaccgcagccgcgatcaggatttcatgcgcgaagccttggcccttgctgcccaaggcgcggcgttgggcgaggtgccggtaggtgcggtgctggtgcaggacggtgaaatcatcgggcgcggcttcaattgcccgatcatcggcaacgaccccagcgcccatgccgaaatggtcgcgatccgcgctgccgcccaggcgatcagtaactatcgcctggtgggcagcacgctgtatgtgaccctggagccgtgcagcatgtgcgccgggttgatcgtgcattcgcgcatcgcaagggtggtgtatggcgcactggagcccaaggccgggattgtgcagagtcaggggcagttttttacccagggctttctcaaccataaggtgctgtttgaaggcggcgtgctggccgaggagtgcggcacggtgttgagtgagttcttcaaggcccgccgagctaaaccaccactctaaagaacactgagaacaaaaaatgtgggagggggcttgctcccgatagcggtgtatcagccataaatgtggtggctgacactctgctatcgggagcaagccccctcccacatttggatcttcatctattcagtgattacttcttggcgatgatcacagcccgcatcggcgccggcagcccttcgatggtcttgctgtgatcttcggggtcgaggaagtcactgagcgactggtacttcatccactctgtcccccgctgttcctcaactgtggtcacgctcacatctacgcacctcacctcactgaatccggcacggcgcagccacagcatcaaggccggcaccgagggcaggaaccacacgttacgcatctgtgcgtagcgatcttccggcaccagcacctgctgctgatcgccttccaccaccagggtttccaagaccagttcgccgcctttgaccagtgtgtctttcagcgccagcaagtgctcgatcggcgagcggcggtggtagaacacgcccatggaaaacaccgtatcaaacccttccaggttcgccggcaaatcttcgaacgggaaaggcaggtgccaggctttgggctcagacaggtaacgttgcaccgcctggaactggcagaagaacaaccagttcgggtccacgccaatcacgctgtcggccccggcgccgagcatgcgccacatgtagtacccattgccgcaacccacatcgaggatacgcttgccgttcaggtccaggtgcggcgcgacccgcgaccacttccagtccgagcgccattcggtgtccacatgcacaccgaacaggtggaacgggcctttgcgccaggggctcaggcccatcagggcagtgtgcatttgcgcacgggtggcgtcgtcgcagtcggtgtccagcaccaggccgttgagcaagtcgacttcactgggttggatctttggcagcgcatccaacgcgctctgccaacgttccaggtcgccatgacctttttccatcttgctatcgagctgcgcttgcaggccctgggcccacacggccaagggagtgccgaccaggtggcgggcgaggggggacaaatcaatcatggcaaggcaatcaacgaggcaaagttaagacactggaaccacggcacgactttcgagaacccggccgccagcaggcgttcgcggtgttcttcgaggctgtcgggcttcatgacgttttcgatggcgctgcgcttctgggcgatttccagttcgctgtagccgttggcgcgcttgaaggcgatatgcagatcggtgagcagcgcgtgttcttcaacatcgttgaagcgcagcttttccgaaaggatcaacgccccgcctggcagcagcgcctggcggatacgcccgagcaacgccaggcgttcgtcaggggcgataaattgcagggtgaagttcagcgccaccaccgaggcgggctggaactgcagggcgagaatatcgccctcaatcacctcgaccggcagcagttcctggaacatcgagtcctggccattgaggtattcccggcaacgctcgaccatcgccgccgagttatccacagcgatcacccggcagccatcggtgcgtacatgacgacgcagggcctgagtgacagcacccagggatgaacccaggtcatacagcacgctgttgggctgggcaaattgcgcggccagcacgccgaggttctcaacgatggtcgggtaacccggcaccgagcgcttgatcatgtccgggaacacccgcaccacatcctcgttaaaggcgaagtccggcacctggggcaggggctgggcgaataggcgatcgggttctttgctcacggctgttccggcgacgagggggaaaggccggcattttagccaagttggtcttcggatgcgcgggttgtctgatggaaagcagaggcggtgatgccccattgcccgagccaataggtgatgatcaacaaatagggggctgcttcgaatgtcactacaaagcggttgataccgatcaacgtatcggaaaacacaaacgacactgcacccgccgccgccagcagcgctgagcgtttcggcacctcgctgcccaaccgcgccagcgcacgccaaagcatggcgctgatcaccagcgcgtaaaccaccaccggtatcagcaactcgcccaagccgtgggatatcaggatgctcagcaggattgccccgactccaagggccagcaccagcggcagcagtgccaggcgccggcagtcactgaaataggccttgagataggccaggtgtgcgcacaggaatgcgcccaggccaaagataaacaggtcccccggccaggcgagcaaaacgtcgccgaccagggaaaaaatcagccccaggctgatccagcgccgatagtcggtgggcggtgcgtcatgcagccaccccagcagtgccagtaccggcagcggcttgaccagcaggcacagcagcgtcgcatgggtcgccaggccgtagatgaaggtgccggcgcccatcaaggcaaggatcagccatggcatatcagttcaccgtaatggcgcagtcaaaggtttcgacgggctcggcttccggttcccagggttgctgggaggtcaggcgcaaacggccctggccagcggcaaatgcctggaagcgccaggtggactgcccgccaccgccaattacgccggattcgctgctgctataaacctcggggctcaaggcgcgcaagacaccgccggcagagtcctggatggcccagcgataaccggtggtggggttgcttggcagggtgaggatcaggttttgtccggttttaagcaggattgggcaactgctctggttttccacgctgatgttttgcttgggagcactggcgcaagcggccagcagggcaaggctcaaggggagaagcaggcgggcagcggtcatgggggctccgtttatacacgacgaagggcgagcataaccgaagatgagacagggtgtgacaagcaggatatgtgtcgcggccactgacgccatcgggggcaaagccccctcccacacttgaatgtgttcacaaatcaaaatgtgtgagggggcttgcccccgatgaggccggttcaggcgctagagctctatcagaacagcaccttcgccacatccgcaaagcgcttggcaaagtgcaccgtcatgccttccttcagatactccggcaattcttcaaaactgccacggttcggctccggcaagatcaactcgtggatcttctgacgccgcgccgcaatgactttctcgcgcaccccaccaatcggcaatacatgcccggtcagcgtcagttcaccggtcatcgctacgcctttcttcggcggttggttgcgcgccagggacagcaatgcactggccatggtcacacccgcgctcgggccgtctttcggcgtggcgccttccggtacgtgcaagtgcacgaaggcttcgtcgaagaacttcggatcaccgccaaatgacttcaagttcgagctgatgtagctgtaggcgatttcggcggactccttcatcacttcacccagctgcccggtaagcttgaagccgcgattgagcgtgtggatacgcgtcgcctcgatcggcaacgtagcgccgcccatgctggtccaggccagaccggtgatgacgccggtgccggacagtacttgctcgttacggaacaccggcatgcccagggagctttccaggtccttgttgccaatcttgatcacgctattgggctcatccagtagcttgaccaccgctttgcgcaccagtttgcccagttgtttttccaactggcgcacaccggcttcccgtgcataaccgtcgatcaacgcacgcagggcgccgtcgctgatactcaggctgttttttgccacgccggctttttccaactgtttgggccataggtggcgcttggcgatggcgactttttcttcggtgatatagcccgacaggcgaatcacttccatacggtcgagcaacgggcctgggatcgaatcgagggtgttggcggtgcacacgaacagcactttggacaggtccaggcgcaggtccaggtaatggtcgaggaattcgacgttctgctcagggtcgagggtttccaacaacgccgacgccgggtcgccctggaagctctggcccatcttgtcgatctcgtcgagcatgattaccgggttcatgacctccacgtctttcaatgcctgcaccagcttgccgggaagggcgccgatgtaggtgcggcggtggcccttgatctcggcttcgtcgcgcatgccgccgacgctgaaacggtagaacggtcggcccagggattcagcgatggatttacccacactggtcttgcccacgcccggcgggcccaccagcagcacaatggagccggcgacttcgcctttataggcgccgacggcgaggaattcgaggatgcggctcttgatgtcgtccaggcccgcgtgatgcttgtccagcaccttgcgtgcatgcttgaggtcgagcttgtctgcgccgtacacgccccacggcaccgaggtggcccagtccaggtagttgcgcgtcacggcgtattccggcgaaccggtctcgagaatcgacagcttgttcagttcttcatctatgcgctttttcgcctgagccggcagcaccttgccttccaggcgctgctcgaactgctcgacgtcggcgctgcggtcgtccttggtcaggcccagctcttgctggatgaccttgagttgttccttgaggaagaactcgcgctggtgctcgccgatcttgcggttcacttcggcggacagctctttttgcaggcgcgcgacttcgacttccttgcgcagcatcggcaagactttctccatgcgcttgagcatgggcacgcagtccagcacttcctgcaactcgttaccggtggccgaggtcagcgcggcggcgaagtcggtgagcggtgaggggtcgttggggctgaaacggttgaggtagttcttcaactcttcgctgtacagcgggttgaggggcagcagttccttgatcgcgttgatcagcgccatgccgtaggccttgacctcgtcggtgggctcgctgggctggtgcgggtattcgacttccaccaggtagggtgggcggtggtgcttgagccaagtcttgatgcgcacgcgggtcaggccctgggccacgaattgcagcttgccgttctcgcggctggcgtggtgcaccttgaccagggtgccgtacagcggcagggcggaggtatcgaaatgccgtgggtcttcgggcggcgtgtccatgaaaaacagcgcgagcgaatggtggtcggatttgctcaccaactccagggtctcggcccagggctcttcattgacaatcaccggcaatacttgcgccgggaaaaacggccggttgtggatcgggatgatatagaccttgtccggcaggttttgcccaggcagggccaggccagtgttggacgaggtggtgtcagcgttttcggggtcggcgtagtcgttcaggtcgtaatcagggacgtcttgctggtcgctcatggggcacctgcataaggaagtatggaggttagatggggcgggtcagcagtggtttcaatggtgggggtgagatagcaacatattgcatgaaattactgcggctacctggagagtatgggagggggcaagctccttcctgacagttgacccgtattgaatcagctgattttgtgcagatacgcaggcagcggctgttccggcaacaccgatagcaccttcaatcgctgcaacatccgctgcctggctcgctgcaaatgctcgcgcagattcaacgctgcggcatcgaacgccccatgcagcaacaattcaagaatcaagcgatgttcggcgagcatggcaggatcggcgccgatccccagtaaacgatggaaaattcggctgataatcatcgggctttggccctggcggatcagggcggcgatcttgcggttctgcaggccggcgaggcagtgctggtgcaagtcctgctcgatctgttcgatggcttccaggctgcaatgggggctgtcctgggcgtcgagcacgcgctgcagcatggcctggagcatgacgcggtccaggtccggtgcactctggcgcagggcttcgggctccaaacaagcgcgcaattcgtagtcttcggtgacttctcgggcagtcagcggccctgcgagccattgggagtaaggttctttctccaccaggccacggtcgcgcaggcgcatcagtgcttcgcgcaccacggcgcggctgacgccgtagtggtcggcggcggcttgctcgtccaggcggtaatggccgaaggcgatgcaggtagacaacgccgcgcctatctcctcgacaattcgctcgcccagcggccgggtgtctaccaactcgtcgtcgtggttcaggcccaggtgtccgtggctcaagggcaggcgcaggggctccatggccaggccgtcggggttgatcaggtaaccgcggccgttgaaacggcaaatcagcccttcggcatgcagcaggtccagcgccttacgcaccggtacgcggctggtaccgaacaagtcggccagcggcgcctcgagcaggaccagcccgtggcgcgcggtgccgttgacgatcgcgtcgcgcaaaactcggtggatcatcgcgtaacgggacgccgaggcggacactgctttcatagctttcctgtggctgtggacggtggccagggattctctcatagatgcgtctgtcactctgcgccacgtcgacggcacttttttggggctgtaaacatgggactgttacttttttgcaccaaaacgtactttttaatgaaaggtacattatttcattcgcgattttggtggatgccttcgcgagatttttatttcatgaaaaactatctagctcgatggttcgaagggagaccgtcgagctagggaagaatcctctaacgagactggcacgaaagctgcctttataaaacgtacattttattaatatgtacgtttatataagggtatgccgatgtcagacgccacctcaatggccgaagcattcgccagcggtcacagcgacccggtgcaggtgcttgaacaggcgctcgttcacgcgagcatggcccccagcgttttcatttccctgaccgtcgagcgcgcccggcgtgaagccgaggcttcggccgcccgttggcgtgccgggcaacccttgagcgtattcgatggcgtgccattggcctggaaagatttgttcgacatggcgggcaccgtcaccacggccggtgctgcttaccgccgcaacgcggcgcctgctgcgcatgacgctcccagtgttgggctgttgtgccgcgctggcatggtcagcctgggcaagaccaacctcagcgagctggcgtattccggcctgggtctcaacccgcatttcggcacgccccacaaccccaatagcagtgatcaaccacgcattcccggaggctcgtcctcggggtcggcggttgccgtggcggccggtattgtgccgattgccatgggcaccgataccgccggctcgatccgcattcctgccgcgctcaacggcgtggtgggctaccgcagcagttgccggcgctacagccgcgaaggcgttttccccctggcacacaccctcgacagcctcggcccgctgacccgcagcgtgcgcgatgcgctggccatcgatgatgtgctcactggccgtactggccgtagccaacgccacatcgccagcagcctcaagggccagcgctgggtgctggagcaaggcaccctggacactatcgagccggtcgtacgcattaacctgctacatgccgtcgatcaattgaaggccgccggtgcgttagtcgaggtgcgtccgtccgccactttccaggccacccttgcgctgatcgaggcgcacggctggctcggttcattcgaagccttcgctttgcacgaagccttgctcgatagcgccgatgccgagcaactcgacccccgtgtgcggcgtcgcctcgaagccgcacgctcactgccggccagccagctcatgcacctgatcgaagggcgccggcgcctgcaacagcagttgatcgacgacctcgacggcgccctgctgatcaccccgacggtggcccatgtcgccccagcgttggcagcgctggagtccgacgatgagctgttcgtcaccactaacctcaccaccctgcgcctgaccatgccgggcagcttgctcgacatgccgggcgtcagcttgcccagcggccgcgatgcccagggcttgcccaccgggctgctgctcagcgccccgacgggggaagacgcacgcctgttgcgcgctgcgttggccgtcgaatccgtacttaacgtttaaggagacacaccatggctaaagatattctctgtgcatttggcgtcgacgtggacgccgtcgccggctggctgggttcctatgggggcgaagactcgcccgacgacatttcccgcggcctgtttgccggtgaagtcggcgcgccacgtttgctcaagctgttcgaacgctacggcctgcgcaccacctggtttatcccggggcactcgatggaaaccttccccgagcagatgaaggcggtggctgatgccggccacgaaatcggtgtgcatggctacagccacgaaaaccccatcgccatgaccgccgagcaggaagaaatcgtgctcgacaagtccatcgagctgatcacccaggtcaccggcaaacgccccaccggctacgtcgcgccctggtgggaattcagcaaggtcaccaacgagctgctgttgaaaaaaggcatcaagtacgaccacagcctgatgcataacgatttccacccttactacgtgcgcaagggcgacagctggaccaagatcgactacagccagcaccccgacacctggatgaaacccctggtgcgcggcgaggaaaccgatctggtggagatcccggccaactggtacctcgacgacctgccgccgatgatgttcatcaagaaagcccccaacagccacggcttcgtcaacccgcgccacctggaagaaatgtggcgcgaccagttcgactgggtctaccgcgagcacgaacaggcggtgttcaccatgaccatccaccccgacgtgtccggtcgcccgcaagtgctgctgatgctggagcgcctgatcgagcatatccagagccatgccggcgtgcgcttcgtcaccttcgacgaaatcgccgatgactttatccgccgccaaccgcgtacctgaccctttgaccaccccccgaggcgcgatccatgtctatctacaacaagcttgacctgactggctggaaaccccggcaattgacgtcccaggaagtgcgctttgccacctggatcgcgtttttcgcctgggtatttgcggtgtacgacttcattctgttcggcaccttgctgccggaaatcggccggcactttggctggggtgaagtggaacaagccgagatcgcgacctgggtggcggtgggcacggcggtggtggcattcgccattggccccgtcgtcgataaattgggccgccgcacgggcatcatctttaccgtggccggctctgcgttgtgctcggcgctcaccgcgatcggcggggcatggggcaagtcaccgctgattctgattcgttcgttgggcggccttgggtatgccgaggaaacggtcaatgccacctatctgagcgagttgtatggcgcctcgcaagacccacggctgaccaagcgtcgcggcttcatctacagcctggtgcagggcggctggccagtgggtgcgttgatcgccgcagggttgaccgcgttgttgctgccaatcatcggctggcagggctgcttcgtcttcgccgcgatcccggccattgtgattgcgatcatggcacgcaagctcaaggagagcccgcagttccagatccataagcgcatcagccaactgcgcaaaagcggcgcggtgagcgaagcgcagaacgtcgcgctgacctacggcgtggactacgacgaacacagcaaggcgggtctcaaggccgcgttccgtggcccggcccgtcgcgccaccctggtgatcggtgccgcgctgttgctcaactgggcggcgatccaggtgttcagtgtgttggggacttcggtgatcgtcagcgtgcaccacatctccttcgagaactcgctgatcatcctggtgctgtcgaacctggtgggctactgcggctacctcagccacggctggatgggcgacaagatcggccgccgcaatgtcatcgccctgggctggatgctcggcggcctggcgttcgccggcatgctatttgggccgagcaatttgccgatggtggtcgggctgtacagcctgggcctgttcttcctgatcgggccctactcggcagcgctgttctttatcagcgagagtttccccaccagcattcgcgccaccggcggcgcgatcatccacgccatgggaccgatcggcgcggtggtcgccggctttggcgcgacccaagtgctggccgccggcagtgactggcagaccgctgcgctgtggttcggcgcactaccgtgcttcttgtccggcgccttgatgtttgccgcacgccatgtgcgtccggaaaccgttcagtaaggagagtgtgatgacgcctaaagttgccttgatcaccggtgccgccagcggcatcggccaagccctcgccgtgacctatgcgcgcaatggcgtggcggtgatgggcgggtattacccggccgatccccatgacccgcagaccaccgtgtcattagtgcaagaggctggcggtgagtgcctgatgctgccgttagacgtgggcaacagcgcctcggtggacgccttggccgagcaggccgtggcgcatttcgggcgcctggactacgcggtggccaatgccggtttgttacgccgtgcacccttgttggaaatgaccgacgcgctgtgggatgaaatgctcaatgtcgacctgaccggggtgatgcgcacctttcgcgccgcgacccggcatatgaaggaaggcggcgcactggtggcgatttcatcgattgccggcggcgtgtatggctggcaggagcatagccattatgcggcggccaaggctggggtgccggggctatgtcggtcgttggcggtggagttggcggcattgggtattcgttgcaatgcggtgatcccggggttgatcgagacgccgcagtcgctggatgcgaagaattcgctgggccccgagggtttggccaaagcggcgcgggcgatcccgttgggccgggtagggcgggccgatgaagtggcgtcgttggtgcagttcttgaccagtgatgcatcgagctatttgaccggccaaagcatcgtcatcgatggcggcctgaccgtgcgctggcctgactgatgtactcaatccaaaaatgaggaggggcggtgcgaccgccactcccacattggaactgtgtttttccaggagttttttatgaatcaactcacccatcgccgcgccgtcatcactggcgccggcagtggcatcggtgccgccatcgcccgggcctacgccgccgaaggtgcccgcctgctgctggccgaccgcgacgctgcgagcctggccgaaaccgccatcacctgccgcaatctcggcgccgaggtgttcgaatgcttggccgatgtcggcagccttgaaggcgcacaggccagtgtcgaccgttgcgtcgagcattttggcggtatcgatatcctggtcaacaacgccggcatgctcacccaggcgcgctgtgtcgagttaagcatcgagatgtggaacgacatgctgcgtgtcgatctcaccagcgtctttatcgccagccagcgcgccttgccgcatatgcttgcgcagcgttggggacggatcattaacgttgcctcgcagttgggcatcaaaggcggcgccgagttgacccattacgccgcagccaaggctggggtgatcggctttaccaaatccctggcattggaagtggccaaggacaatgtgctggtcaatgccatcgcgcctgggcctatcgagacgccgttggtgggcggcatcagcgacagctggaaacgcgccaaggccgccgagttgcccctgggccgtttcggcctggcggacgaagtcgcgccggtggcggtactgctggccagtgagccaggcggcaatctgtttgtcggccagaccctgggcccgaactccggcgatgtcatgccatgaacgaggtgtagccatgtgcggactctgcgggctgttaggtgaggatttgcactggagcgatcccttgggtgacgagttaccgcgacgtcgtgagcgcctgcgccggatcgcggcgatcaaccaggtgctggcggcgtttcggctcaaggtcgaagactttcagggtgcgtcgtatctgctgctcggcgccaccggtaaacaggcgctggcgagcggtctggatcaactctggcaagcagctgaaaacatgctgggccgacccttggatccccttgattcgcaccttttggatcacctggagtcggctgtatgagcatcgccctgaatgtcatcaccggcttcctcggcagcggcaagaccaccttgctcacccgcctgttgcacggcgaaagcctcggtgacacggccttgctgatcaatgaattcggcgacgtcggcatcgaccatctgctggtagaagaggtcgcccccgacaccgtcctgctacccagcggctgcgtgtgctgctcgatccgcggcgagttgaaagacgcgctgctcggcttgctgcaacgccgcgaacgcggggaaattccggcgttcaaacgggtgattctggaaaccaccggcctggccgacccggcgccaaccctggcgactctgaacaatgacgtgcaattgcgcgggcgctttcatatcggcctggtcatcaccctggtcgacgccagccacgccgcgctgcaagagcgcctgcacccggaatggctggcccaggtggcggcggcggatcgcttgctgttgagcaagaccgacttggcaggcaactgcgagccactgcgcgcgcacctgcgggcaatcaatgccggcacgccgatcctcaacaccttggagattcacagcggcgagcaactgcttctgggcgaaggcttgcgcagcgccgagccggccgtggaagtcagccgctggcaactgcgccccaccaccacgaccacccacggcgccgcgcaggtgtgctgcctgaccttcgatcaaccgctggactgggtcggtttcggggtgtggctgtcgatgctgctaagatgccacggcgaacgaatccttcgtgtcaaaggactgctcaacgtgaacgccagtaacgctcccatcgtcattcatggcgtgcagcactgcctgcatgccccggtccatttgcctgcgtggccgggcaaagaccgccaatcgcggctggtatttatcctgcgcggccttgatccggcgctgctgcgccgctcctttgaagtcttctcccggcggttcgcggcatgatcaccctgcgtgtccttggcacatccgtgaccctgcttgaaacgctgcgcgtgcgcgccgaacaggacctgggtattcgcctggtataccaggtacacgatgtcgagcaggcccagcgcatcgcggtgatgcagcccgatagctatgacctgtatgaccagtggttccacaacgttgacttcgtctggccggcacgggcgatccagcccattgacacccggcgtattgccctgtggcatgagatcaatgacctgcccaagcgcgggcgcttgtctgcaggcgaccgcctgggcagcggcagcgtgcccagcgaacgtctgttcgtgcagcacgatggcagcctcggcagcaccgtcaccgagcgcatcagcatgctgcccctgactcacaacgccgacagtttcgcttaccgccccgagcgtttgcctgaaggcttttgcagccgcaacgaaagctggggctggttgctggacccggcctggagtgcgcgcaccgccttgcagagcgacgccgccatcggtgccctggatgcggcgttggcggtgcagggcgccgggctggcgacattcaaggacatcggcaatatgagcatcgaagaaatcgatgtgctggccgacatcctggtgcgcaagcagaagcaagggcacttcgcggcgttctggtcggacgatgaagaagccgcgcagctgatgctcagcccgaacatcgatattcagagcctgtggtcgccgaccttgatgcgcctgcaccgtgccggggtgaaataccgcctggcggtgccccgcgaaggctatcgcgcctggttcggtggcttgtctttgtcgcgccatgcccaggggccggtgctggatgcggcctatgcgtacttgaattggtggctttgcggctggcccggggctgtcatggcgcgccagggctactacatcggcaacccggcgcgtacccgtgatcacctgagcagcgccgaatgggattactggtacgcgggcaagccggcacgggaggagctgccgggcagcgatggcttgccgctgatcgatatcggcgatgtgcgcgatgggggctcctatgaacagcgcatggggcatatcgccgtgtggaattcggtgatggatgagcacaactatctggtgcgccgttggggggactttatgcgtgcgcgaggtgcataacctgtctggtcaataatatgacgctaatctcccggtatttattgggtttacttatgcccagtcccagctaatctgctgaaatcgaatattccatttaaatggatatttttttgacgccaggttaacagttggcagggacgcgtatgaccacaggaagggggcccagagagcgtcgagcacggccagagggcatggcaatgcagtggcgccacacttttcaaacccgcattgccgcggtgttggcgctgttgttgctggtggtcgtggtcgcgacttacttcgcggtcaaggctgccactactcgcgctgtggaaaaccaggccgaggtgcagctgaacaccggtcgacaggtgttcgaacgcttgttggacctgcgcggtcgccgtctgcaatacggcttggaatggctcaccgtcgacggtcctttcaagcgtgccgtggccagcggcgaagcctcggcgatacaagcggcgctgcgtcggcacggaaccggtgtcagctccagtgcagtgttcgtacttggcctcgatgacaaggtcatcgccagtacgttacccgtgctggctcggggccagctctttccctatcaagaggcgttgcgccaggcgcgacgcagcagtcagcaaatgctgatcgtggcgatggatgggcaaccctacttgctggtacaaaaggaaatgctcgacccgcagcccatcgcccgcgtggtcatgggcttccccatggatgcgcaatttgcccatgagctacggtccatgagcaaccttgaggtgtcgtttctcagtgtgcaggacgatcgtgtcggccagctctttacgacccaacccgacggctaccgcgctacggtcaccagcctgctgcgtgccgcgcaacttgatcgacaggcgcaggtgtatctgtttcatggccagcgcgtgctcagccaagtactgcctttggccaacgccggtgaacgcgacgaggtgcgcgtcttgctgcaaagcccgctggatcatgccctgcaatcctttgcaccgctggaccggcaatttctcgcaattgccctggcggtgttgctggtctccctggcggcggcgttgttgcttgcacggcgagtgtcgcgccccctcgatgcgttggtgcaagccgccgaacgcatcggtgccggtgactaccgcacgccggtgcgggtgcgtagccatgatgagttcggcctgctggcccgcgccttcaatgccatgcaaagcggtatcgccatgcgcgaacggcaactggcccataacgccttgcatgacccgctcactggcctgcccaatcgtgccctggccatggagcgcctgggcagtgcgatcagtgcgcggcggccggtggtgctactgtacctggggattgaaaactaccgggtcatcaatgagagcttcggcccccagggagtcgagcaaatgttgcgcgaagccagtcgttgcctgtccatgagcctgctggccagcgacactgcggcacgtatggccggcagtgaattcctgctgttgctggaaaacaccggaatcgaccgcgctgtggcccgtgccgaccgcctctacggactgctgaccgaacccaagcacatcggcaacgacgaagtgcgccacgaagtgagcatcggtatcgcggcgtaccccgctgacgggcagcaggtagaggaattgatcaatcgcgccgccatcgcccggcatgacgcggccaacttgccggggcatttgcagatataccagccggaccgcgacctcgctcaccaacgccagatcgccctgatccgcgacctgcgccgcgcggtgatcgaacgcgagttgttcctgtgctaccagcccaagctcgacctcacccatggccacgtgcgccaggccgaagccctgttgcgttggcaacatccaagcttcggacaagtctcgcccgctgagttcattcccctcgccgagcgtaccggcagcatgggcggcctgaccttatgggtgatcgaggaggccattcgccaaatggcagagtgggcgcagcgtggcttgccgatgcagctgtcagtgaatatatccgtggatgacctggctgatgatgacctggccgttcgcgtcaccgcaatgttgatgcaatacggggtggcggccgaacacttgattttcgaaatcaccgaaagcgccatcatgcacaacccgcaacaggccctcagcgtgctggaacagttgcgcggttgcggcatcagcctgtccgtggatgatttcggaaccggttactcatccctggcgcaattgcagcgcctgccagtgcaagagttgaagattgaccagtcttttgtgcgcaatctcgacagtaccagcggcgatggtgtgatcgtgcgctccaccatcgagatgagccataacctggggctcaaggtagtggccgaaggcgttgagttcgagcacagcctcaccctgctcaagcgttggaaatgcgacaccgcccagggctacctgatcagccggcccttgaatgccatggcgttcgagaggtggatgaggcgtgagcgggtgcctatctagaaggcatttcaatcaccagggactgcaatagcgcccacaacccttcgacatgctggcgctccgtgcccagtgcgccgatggacacgcgcaccatccagcgttcatcgaggatcgccggcgtgacgtaggctttgcctgacaggttgagcctttctgcccagtcgcgcgtgtgcttatccagcgcttcgccgctcaagcctggcggttcgtggcgaatgcacagggtttgcagggccggcgcggccaccagtttccagtgcacactgccctcaatctgctccgccagccagcgcgcattggccaggtctcgtcgcagccgcgcttgcaggccgctgacgccttgctcgcggatcaggaaccacagcttcagggcgcggaagcggctacccagggaaatccgccagtcgcggtagtttctgacctgaccgtcggcgctggactgcagatagctcgggttggtggtcatgatgcgaatcaaatgctcagggtcacgaacgtagtacaccgagcaatcgaaggccgcgcccagccacttatgcgggttgaggaccagggagtcggcgttttcgataccacgccacagcgcccggcattccggcaggatcatcgcggcgccggccatggccgagtcgacatgcagccacaagccatggcgctgggtcagttcgccaatcgcatccagggggtcgatcgccatggcggccgtggtcccggtggtggcaatcaccacgcaggggcggttgccggcggccaggtcctgctcgatggcttgcgctaacgcctggggtgacatggcgttgcgttcgtcggtggcgaccgtgcggatattgttctggccgaatccagcgagaatggccgccttgttcactgaactatgggcgtgggccgaggtgtagacgatcaggggcgcgccgctgtcttgcaggccgtcatgcatcagcgcgtactgggagctgcgttccctggcgctgatgagtgccaccagggtggaggttgacgcggaatcctggatcacgccactccattcgtggctcaggccgatcatgtcgcgcagccagtcggtggtcacttcctcaatttcggtaagcgccgggctggattgccaagacaatcccaccacacccaagccggtgctcaggcaatcgcccagtactgaggacagttccacgttggaggggaagaaaccgaaaaaactcggatgctgccagtgcagcagcccgggcatgatcagtttttccacatcacccatgatctgttcgaagggttcggcgctttcaggcgggctggccggcagggcggctttgatttcgccaggaacagtcgtgggctgcacgccgcgttgctcgatattttctcgatagtctgcgatcaggtcgatcatggcgtagccatggcgacggaattcttcgggggtcataaaaacatatccatttgcaagcgggttaaaagtatcagcaccagaaataaaacggttcgccaggggtatagccgataaacgactgcatgctgatacgttttcccgactcgaatccgcaaatggcgtgggggcggcgggtattgatgatcaccagttcgttgttgcgcggctggatacgtaacggcttttgcaaacggtcctcgggcagttgtgcgccttcgaaacgcttgacctcgtcataggcaaaggcctcggtatcccagatgatcaactctccgcctgatggcggcgtttccagataaatattggcgctgaattggtgttccagttccgcgatcgacagaggcaggcaatccacatggggaaccgtttccgagaggtgcgccgtctcgggaaacatggcacggataatcccgcagaacatcggttggccttgaaaagctgcggtgactgcgccttgcggccagatctcctggagctgctccatcaggtgttggatgggcggcttttcaggtgcgcaaatgctgtcgatcacaccgcgcatatgggccgcgtcagcataatatttggcttgggcatcgctgccggcagccttgccgtaggtggagttgaacggggtgccccagcgatgcacgccgtagaaatgctgtacgacgtggccatcctcgtaggtttcatggctgtattgttccagcgtgtcggcctcaccgatgatttgatttaaccgctcgctggttttggcgttcgcaaactcaggtattcggatagcaagtacttctccactgatcagttgtttcaaacttgaggtgtcgagatattcaagttctataatttttgctgatttggacgtggttggttttgtcgcagcatggtccatcatgttcagaagctccctttagagttttatcagtaggcgtatagggtacgcagggcgtgtgcagtaaattagttttaagggcgcaggggaccgataggatttttcttgaaacgctggttttttagccggctgattaatcgcgtattaacgatcgtcaatttttggcagacgaaaaaaaaagcggctacccatcaggtagccgcccttgttttaccgccgggtccacttaatccggcagtttgaacgccatcacatagtcaccctgtttggtacccagggaaccatgaccgccggccatgaccagcacgtattgcttgccgtccttgccggtgtaggtcattggtgtggtttgcgcgcctgcaggcaggcggccttcccacagttgcttgccgtttttcacgtcataggcacgcaggtactggtcgagggtgccgctgaggaacgcgacgccaccggcggtggtgaacgtaccgcccaggctaggcacacccatggtcagcgggataggaaccggcgagctgtcacgcacggtgccgttcttgtgcatccagatggtctggtggttggtcaggtcgaccgctgccacgtagccccacgctggtgcctggcacggcaggcccatgggcgacagcagcgcttcgaggatcacgccgtacggcgcgcctttgtttggctgtacgccttcggtttcgctgacgcgtgggccttgcttggcgatgtctgcagccgggatcagcttcgatttgaacgccatgtagcttgggttcacgaaggcgatctggcgtactggatcgaccgagatgccgccccagtcgaacacaccgaagttacctgggtaaacgatcgagccttgcagcgatggcggggtgaacgggccgtcgtagcgcatcgacttgaagtcgatccggcagatcagttggtcgaacggcgtaacgccccacatgtcgcgttctttcaacggcggcggcatgaagttcaggtcggacttgggctgggtaggggaggtacggtcgcccgccactgcgccttggggtacggcaacttcgtggattggcaccaccggctggccggtagcgcggtccagcacgtagatgctgccttgcttggtcgacgccatcacggcctgcttgacgccggcttcggtcttgatgtcgatcagcgaaggctggccgccgacgtccatgtcccacaggtcgtggtgggtgaactggaaggtccacttcacgtggcctgtgtcgatgtccagggccgtcaagccagcggcgtatttttccgaatcgtcggtacggtcgccgccgtactggtcgggcatctggttgcccatcggcaggtaaagcatgccgagtttttcatccacggcgaacatggaccacatgttcggcgagttgcgggtgtaggtcttgccctcggccaacggggtggtgtcgtccgggttgccgctgtcccagttccacaccagtttgccggtgtgcacgtcgaacgcacggatcacgccgcttggctcatcgatcgaaacgttgtcggtcacgtgaccgccgatcaccaccaggttcttggtcacggccggtggcgaggtggagtagtaaccgcctggggcgaagctgccgatgttggcacgcaggtcgacctggcctttgtcaccgaagtcttcgcacatcttgccggtgtcggcgttcagcgcgatcaggcgagtgtcagcagtagggacgaagatacgtttcgggcaggcattcggcgcggcagccgggctggcgctgccggttgggctctgctcggaagcgtaggcagcgtcatcgtggtacgacacgccacggcaagtcatgtgcgcccaacccttgaagctttcagcaccctgggtggtgatcttcgggtcgaaacgccagatttccttgccggtgtccgggtccagggcaatcacttggctgtgcggagtgcacacgtagagcatgccgttgactttcagcggggtattttccgcggtggtttcaccgggatcgcctgggccagggatgtcgccggtacggaaggtccacgcgggtaccagcttatgcgcattttccggggtgatctgtgccagtggcgaataacgatcaccgtgggcggaacggccataggaattccagtcgccatcagcctgggccggtgcagcgctggccatgcccggcaccgcgtcgcggtccagttggccggtcttgaccatttcacctgggttggtgaactggctggccagggcggtagcacccgccagcaccacggccacgctcagcgcgccagtgcccagtggcgcggcttggccacgcaacaacggacggcgaaaccacggcagcaacatgacgatgcccagggcgaacagcagggccaggcgcggcaccagttgccaccagtccaggccgacttcccacagtgcccacacggtgctggcgaacagtaccagtgcataaaggcccagcgcggcgcggcgggtggcgagcagcaatatgccggtcagggcgatgccaataccggccagcaggtagtacagcgacccgccgagcatgcttagcttgacaccgccggccagcaaggccagccccatgatcagcagcaagatccccagcagcctgggcagcaggcggcttgggcttgaagccccatcagtgctcatagtgtgtttctccgttacgttggaattatgtaaccccgtgcttcactcactgtagatgacgattcggctcgggcttggttcatcgttatttttgatttttctgtggataaccgggttatccacaggcgggcaataacccatccagcgctggtcgaggtaagacagcgctgtctttgcgtataggaaaaattggcaaaggggatcgaccgggaggtgaagcgtttcagattgttgcgaagaataatgcggcggggcgttttgagaaagggtgaatcgcaagatgcatcatttcagttttggtaacagtgactcattgtcgctgcaaaattgaggtgggagggggcaagcgccctcccacaaaggatttgctgtgttggtcagaaggtggtgcggatgccgaactgcacactgcgccccggtgccggtgcgatgtcgcgcaggatcgagctggcatagcgcacggtctggttggtcaggttctcgccgttgacaaaggccagccactggctcccaccgacattgaagcgataccccgcgctggcacccagggtggtgtagccatcggtgccgctttcgttatccggcacgcgcccttggcctgctgcgtgttccacatcgatacgcgcctgccagcggtccagttcccatagcaagccgctgttcaagcgcagcggcgcgatgcgtggcagggcttcgccggtatccaggttggtggcgcgggtgtagtcacccgacagttccagtgcaaacttgccgtaggcgccttcgccgagcttccagtgatcctgggcttcgaagccggcaaaacgcgcacgcacaccggaatattcgtattcggggataccgcttgcgtcctcttcaccctcatcgttcaaagtgcgccccgtgccgagcaggccgatgtagttggagaagcggctgtagaacacgccgaagctgcccttgtgggcgccattgtcaaagcgcagtgcgaggtcgctggacacggctttttctttcttcaggttggcatcgcccagctcaaaggtgccagtggcgacatgggcgccgttggcatacagctcatagaaggtcggtgcgcgctcggtgtagcccaacgtagcagccagggaccagattggcgtgagggtatacaccgcgccggacgacaggctgccggcggtgaagtcattgcgcttgctggcattggcaaatcgctcgttgcccttggcatcgggatcgacgctggtgtgttccacgcgggcgccgaggctgagtttcaggcgctcggtggcttgcatctcttcgagtatgaacagtgcgccggcattggtgtcggtctgcggcacgaaagcttcttcgcccagggccgagaactcgttgcgggtcacttgggcgccgaccacgccgtcgaatgggccgatcggctggtggcgagcttcaacacgggcttcatagcctttgttcttgaagatcgtaccggtctcgccgccttcgatttcgcgatgttcatagtcggtgtagcccgcgtcgagtttcaccgaggtgaacggcccttgcaggttacggatttcggacgcaaaggcgtagtgatcctgctgcatgcggatgcgcacatcctgctcggccggcgagccgtagttgctgtcgtagttgctgtaggacagcccggcataaccatcgtcccatgtgtaggaaccgccgacggcaccaccgtcctggcgcccgtcgctgttgcccaggcggccattcttgcctgggccgtcttcggtggtcggggcatggcggctgcgggcataacctgggattttcaggtcgttgaattcccgtgcattggcatccaggtgcagggcgaaggtgccgttgccggcttccagcttgcccgcgctgctacgggtggtatcggcgccaccgtagcgcaactcgccggcgccgtggatgccttcgatagcctctgtggggatgcggttgtcgaaggtattaaccacaccgccgatggcgctgccgccatacagcagggcagccgggccgcgcacgatttcaatgcggtcaacgttgatcggatcgagcggcaccgcgtggtcgtaggacagcgacgacgcatccagcgcgcctacaccattgcgcaggatacgaatgcggtcgccatcctggccgcgaatgatcgggcggctggcgcccgggccgaaatacgaagatgacacccccggttgcttgttcagggtttcgccgaggctgcctttttgttgcaaggtcagctcatcaccttccagtacggtggtgggcgaggccagttgttcgctgcccagtgggttgccggtgaccacttggggtggcaattccagggcatgggcttgggagctgatcaacaaggcagcggcgagaggggacaggcgccagagagaaggcagggacatcggatattcctaggtaaaacttctgttagatatggttacaatataacatctcttttttatcggaaagtggaacttttcctggcgggctatattcaatgccatgcttccacctgcacgcctcgtcggctaaggtgcgcggctgtgtttcctctatttgcaaaaggcccggcatgaccgcgacaagcaacgacccgctccacggtgtgaccctgcaacacgtgctcaccaccctggttgaacattacgagtggagcggcctggccgagcgtattgatatccgctgcttcaagagcgacccgagcatcaagtcgagcctgaccttcctgcgcaagaccccttgggcacgggagaaagtcgaaagcctgtacgtcaaactgatgcgcaccaaacgcccgctggattgaggccatgaagcgctttgtggcggtagcggcgctggccggttgggtggggctggcgatccagcaatacctgatcttctattcacgctgggccatcgacgccagcctgttgggtgggctgatcagctttttcagtttcttcacggtgctgaccaacaccctggcggtggtggtgctcagctatgcagggaccaagcgcgactcagcgataaaacggtttttcctggcgccagtggtcagtagcgcagtcgccgcgagcatcattgtggtgagcctggcgtataacctgctgctgcggcatttgtggagccccgaaggctttcaattcatcgcggatgaattgctgcatgacgtgatgccgctgctgtttgtgatctattggtggcagtgcgtgccaaaggggcagctgcgtttcaggcacattggtgcctgggtgatctacccattggtgtacttcggttatgtgctgttgcgcggggatttgctcgggcagtatcagtacccgttcattgatgtgctgaccctgggttacccacaggtgttcgtgaatgccggagggctattggcggggtttgtgctggtggcgctggtagtggtggggctggataagcgcctgggccgggcgcactccaactgatacagcttgatccaatgtgtgagggggcttcagtcagttaagcgtacatcgccctcctacaaagagccttaactgactgacagtagggcaagccccctctcacatttcgaccgtgtcagccttattcatcttcgctgccttcggcccgccagtagcccacagccttcaagaactcctcgttgaccttgtgcgtatccagcaacacccgccgcacctggcgtgacagcttggtttcggtcgcgacaaaactgtacagcgtgccgccaggcagcgtcagattgcgtactacatcgagcaggtcttcctggccgcgcaccacccaaatagtctcaacatccgcagcgctctccagcacttgctgttccgctgcatcggcgatttctatcaccgccagcacctttcgacccgccggcagttcttccaggcgccgcgcgatggccgggattgcggtttcatcgccaatcaacaggtagctgtcgaagatatccggcacgatcatcgagccccgtggcccgccgatatacaggtactggccgacctgcacctgctcggcccaggtggaggcggggccgtcgccgtgcagcacgaagtcgatatccagttcaccgatgctcaagtcgtagcgccgtggcgtgtaatcgcgcatggccggttgcgggccgtcgcccttgatggtgaatgtggggctttccagtgcggcttgttcggcggcgttctgtgggaacagcagcttgatgtgatcgtcgctgcccaggctgacaaagccggccaactcgggaccacccagggtgatgcggcgcatgcgcggcgtgaggtcgaccacccgtaggacttgcaggcggcggcgtttgatttcgtgggtaacgcgatggatggcttgagtattcattggtctttcccgtcgacgatggcttgggcggtgccgttgagcagcgccgcgacacgaacgatttcttccgggctccaacgcccatggtgcgaatgcaaggcatgacgcaggttgtgcaccgcctcgtggatttccggcgggcggtcgtggccgcgcagtgagcgcttgctgacttccatgcgcatgcgaatgccttggagggcaaccgcctgttcgcttaagaagagacgaccggcgtcagtgattgtgtagcgtttttttccgccttcggcgtcaccgctgatcaattcgctctcttcaaggaaggtcagggtggggtagatcacgcccgggctcggggtgtaggcgccgtcgaacaggttttcgatctggcggatcaagtcgtagccatggcagggctgttcggcgatcagcgccggcaacagcagtttcaagtcgcccggcgcgaacacccgagggccgcggcctgggcgtttatcgaagccgtcacggccatggtgagggtggtgctctctcatttttaagttctccgtcttggttaagatagaacttaagatatatcttttgatttggcaagctcgggcgactgatggtcgggcagcggcaggtgtaagaggggggtgaaaggaacatccgctggcgcggtccggcagacgagcacgcacattatcttcgatgcgcagcagcccgcttcatgaccggtggcacagcgcctctcccgtcgcttccagatacggcaccagcatcggtgccatgcccttgagcacttgcaccggcaaggccgaggtaaaggtgaagccttgggccgagctgccgggaacgaacgcggtgagggtgccgaagtggcggtcaccgataaaaaacacaaaggtggcggtgcggttgatcgccttggagctgagtatccgcccaccggcgccgatggcttcgatgcggttgtcgccggtgccggtcttgccacccatggccaggggcgtgccgtcggccagcttgaaactgccggccacgcgcttggctgtgccggcgtccaccacctgggacagcgcgccgcgcagggcccgggccacttccaccggcatcacgcgcttgctgcggttggggtcgttgaccaggcgggtatcatagggcgtgccggcgccgaagtgcaggctgtcgatgcgcagtaccggcaggcgcacgccgtcgttgaggatgatccccatcaactcggccagggccgccgggcggtcgccggagctgccaatggcgctggccagggacggcaccaggtggtcgaaggggtaaccgacggcctgccagcgctggtggatctccaggaaggcttcgacctcgagcatggtgcggatccggctgtcacgggcgctctgatggcggctcttgaacaaccagctgtagacctcctggcgttcgaactggctggccttgaccacctcgctgaacgtcgcttcgggatgcttgagcaagtggcctaccagccacaggtccaacgggtggaccttggcgatataaccttggtccggcaggtcataggccccggggccgtaatcccgatagagtttttgcaggcgttcgtcgctgagtttttcattcgccttggcgccggtcaggtgcgcacgcacgaaccggttgaaactgtcctggctggcgtcgggcaacaggtagcggtgtacggcggccaggcgcatgggcgtggggcgcaggccgtcgagaaaagtatcgagacgtgcctgggtgtctttcttctggtacttcttccagaacttgcgcaggtaggtcgtaccttcacggtcggcgaaaccggcgaggtattcctggcgacgcgggtcgctgtcgtccttgagcagtgccgcgctgttgttggcgccagagtaggtggtgaagcgcaccaggtcacgcatcaggcgaatgaagggcaggttgatcgactcgcgcagggcgtcacgcaaggtcgggttgcggtggttgtcttcattgcgaaaattatggaagtgatgcaggccgccaccggtgaaaaaaccttcgtaggggctggccgagtaggtgcggtcgagggcagcatcgagcatgtttgccagggatttatccgcagcctggatcaggtagtcgacggcccagcggctgatacgatcctgctcggcgatgtcgagtttcttcagggcggccggggccagtacggcgtacttctcgtgcagctcggcgatgatctgcaggtaggtggtgagcacccgcagcttggcggtggagcccagttcgagcttgctgccttcgttgatgtcgaaaggttggtcggtattgtcggtttgcacccgcacccgcgcaccgtcggcggtgcgctcgaacagggtaaaactgtagcgcacctgtgcggtgctggcggggctgagcaagcgttcaccgagcaggccgagcttggcggcatacgctggttcggcgagctgcttgaggtagtcggtgagttggttctgcaaggagccttgcaaggtactggtggcggccaggtcgaggcgatcaaggtcgtacagcgggcggttgagcaggccggccaattggctgcgcgccacgctgatgcctttattgctgtcgacccgttgcaacgtcggttgctgttgccaatcacggaaactgacctgggcagccagcgccgccttggtcaggtcggcatcaatgatctgatgatgggccaacaagcgcaggtggctgtcggtcagttcggtcaactcgtcgcggcccttgatcaggtaatgggaaggacggcgctgggcaatcatcaacgaaagtacctggcgcaaggccaggccacgtgcggcgaggctggtcggggctcggccagtgtccgccagcgcccggttgacctgggcaaaatcggcgccgtaccacacccgcagcccttcggccatgccgtgcacctcgccatgaccgggcactgccgacagcggcacgctgttgaggtagtcgcgcaccacgttttgccgggcggccagggtgtcggggccatgctggtaggcgcgcacgctggcggacagcatctggcggattttttcactgcctgacagggtcaggccgtcgggtgagtggcggtacttttccagttgggtcgccaaggtgctgccgccggccgtttgcccgggcaagtgcaactggcgggcgacttgcgaccaggccgccttggcaaatcgcggccagtccacggccgggttggcctgggccgggtcggggtccagcagttcgcggttttcgatgaacaacaggctgtgcaccagcagcggtggcacgtcggtgaagcgtgcatacagctggggcgggtagctgaactgatacagcggcgtggcgcggcaatcggtgatcgacaacccggcctggagtttctcggcgtagggaatgaataacccatggcgactgtaattcatcagcgcctcggagaagcgtgcctgggatgcgaccacgtagttgcgcttgagcaggcgcggcaggaactcacccagggcgctgtagcccaggcgctggtcaaagggccctgcgccgggataaacgatggcatcgctggcgccggggccgacactgtaggtcagctcgcttgcccactggctgaataagcgggcttgcaagtgggcgctgcgcatttcccgtagtgcggcataaccagcggcgagcacggccattaacacaatcagccagcccagccgccgccagagacggggcggcggtttgcttttcgacaaaggcgcgggggacgggctgtcgttattgacttcagccttgctcggatcggtttgccacagagcgcccatagtcgattgatccatgcagattgatcggacctgtctcaagcgtagacgtagattggcggttcagacgggcgcattagacggactgggcactggctcggcgacctcgcccaaggaatttttcgtacctggcatttcaaatgctgatcagtgatacgccaattgtttttccggtgatgcgcgtattgagtatttgtgattgccgggccatgccttgctggccaggcgcttgtttttcagcgtggattagccctggcgcctggtggcagctcgctcgtcaacggcgcggacacaggggcccggatgcagacaagttatgtaataattcccgccgttttgcgccgtgaaggccgatttagacgcttgcaactgcagccgtcgaaagcggtttttacggggcttatcgccaaattttgctgtttattgagtgaaaagccctgtccgtagctttttatactgcacgccccgctgacctgcccggtttttacggtcaggcgggtttgcccacgaggcaggcccggtcccagccggtgtatcaggccatccgctgatacacctgaggctcggtggctaatccaataacaagatgaggttgtacccttatgccagtcggcaacccactgccccatggcgagaccgctcaaggcggcccgctcaaacgtgaactcggtgaacggcatattcgcctgatggcccttggcgcctgtatcggtgtcggcctgttcctcggctcggccaaggccatcgaaatggccggcccggcgatcatgctctcctacatcattggcggcctggcgatcctggtgatcatgcgcgccctcggcgaaatggcggtgcacaaccccgtcgccggttcgttcagccgttatgcccaggactacctcggcccgttggcgggctttctcaccggttggaactactggttcctgtggctggtgacctgtgtcgctgaaatcactgccgttgccgtgtacatgggcgtctggttccccgatacgccgcgctggatctgggccctggcagcactgatcagcatgggcaccatcaacctgatcgcggtcaaggcgttcggtgagttcgaattctggttcgcgttgatcaagatcgtcaccatcattgccatggtgatcggcggcgtcggcatcatcgccttcggtttcggcaatgacggcgtggcactggggatctccaacctgtgggcccacggcggtttcctgcccaatggcgtgcagggcgtgctgatgtccctgcaaatggtgatgttcgcctacctgggcgtggagatgatcggcctcaccgccggtgaagcgaagaacccgcagaagaccatcccgaatgccatcggctcggtgttctggcgcatcctgctgttctatgtgggcgccttgttcgtgatcctgtcgatctacccgtggaacgaaatcggcacccagggcagcccctttgtgatgactttcgagcgcctgggtatcaagaccgccgccggcatcatcaacttcgtggtgatcaccgccgcgctgtcctcctgcaacggcggcatcttcagcaccggtcgcatgctctacagcctggcgcagaacggccaggcgccggcgaccttcggcaccacctccagcaacggcgtaccgcgcaaggcgttgctgctgtcgatcttcgccctgctgctgggcgtactgctcaactacctggtgccggaaaaagtctttgtctgggtgacctcaatcgccaccttcggcgcgatctggacctgggtgatgatcctgctggcccagctcaagttccgcaagggcctgagcccggccgaacagaaagccctgaaataccgcatgtggctttacccggtcagttcctacctggccctggcattcctggtgttggtggtgggcctgatggcgtacttcccggacacccgcattgcgctgtacgtcggcccggtgttcctggtgctgctgacggtgctgttctacgtgttcaggttgcagccgaccaacgctggtgagggagcggcgctcaagcagccatgagccactgagcgtgcctgtgcacgcaaacgtggcgcctagaggggcgccatatttgcgtgccggtgcccctacctatctattcctccctgcggttattaactctttaggctggctgcttcgactgccattttttaaagagtgacaccatgcccgacagtaatcccctgctgctgccttatgatcggccgccgttttcaacgatccaggcgcaccacctggtgcccgccattcagcagatcatcaccgagtgccgcagtgccaccgcttcgattattgccagtcaggcagcctttcccacctgggatgacctggtgttggccgtggatgaactggaagcgcgcctggatggttttgtgcatgtccttacgctgcttgactccgtcccccaagggttggcctggcagcaggcatcaacgcgtagtcaagcgatggcaacacagtacaaagccgagctggcaggcaatggcgacctgtatcggcttcaccgacaactggccgccagcccgatcgccgcgctgtttagtgagcaacgccaaggcgcactgcaaaaaaaactgcgcaagtaccgcgtggccggccttgagctgtcaccggacaagcagctacagctcaatgcgttgaaccaagacatcgaggtcttcagccaggcattcctggaccgcgtgaaaaacgcaaacgatgcatggcgcaagcacatcctggacgcgtcattgttgagcggattgcctgattcagctcaggcgcgcatggcggccgcggctacggcggccggtctgcaaggctggttattgactctgtcggagcagtcctttcgcgaggtgatgacatacgccgatcatcgaggcttgcgtaaagaaatcatgctcgcttactacagccgtgcagtggacagtggcccggatgcgattgccaatgacaatgaacaggtgctgacaacgttgctctatagtcgtcatcagaaagcgcagttgctgggttacgccaatttcgcccaactggcactggtagagcagatggcaagcacaacggagcaggtcagcgcatttattcaccaacagatcgacctggcacgcacaacgtttacccacgaggcacagcaactgcaaaactatgccgcgcaacggggtatcgatgtgctggagccctgggaccacgattatttcgcggaaaaaatccgtcaggatctggcgggcatctcccagcaaaccgtgggtaactatttcccgtttgagtgggtactgcaaaggctgtgcatgtttgccaagattctgttcggcgtcgatttgatcgaacaggccacggtcgatacctggcacccggatgtgcgggtatttgagctcagagagtactcagagccgatcgggtatttgttcattgacccttatcgccgcagtgaaggggcggggtttggctttacgtccagtctacgaagccaccgaatgacagctgaaggacgaccaaaactgcccatggcgatgctgcgtacccagataccggccccgaccacgacccatccttgcttgctggatcatttacagctgcgggtcttgctacacgagtttggccactgtctgcagcacctgttgacctcggcgccttatcggacgctctccagtattgatcaactgagccgtgacgcgtcggagttcgtcagtcaggtcttggagcagttctgctttacaccctcgttcctgatctggctctcaagccatttccagacgggcgaacctttgcctgacgacatggccaccaaaatcagccggttgattcacacccagaccagccaggaaaccgccagggttttgctcacaagcctcgtcgacttcgaattgcaccgtacctttggcgacgggcgtacgccccatgaggttttcagccaatgcaacgcgcaagttggtcatttgcaatggccggctggcgctcgtccactcaatagctttgaacagcttatcgactacggtgccaacgcctactcctacaggtggtcgggtgtcctggccaggcaggcatttgaacggttcgagcgtgacgggctgttcaacccggagaccgggagagcctttcgtgaagcgttcatcactcaaggggacaccggcacattgttaaagtcactggcgctttttcggggtgaaggcgactcctgcgccgagcactccaaggcatgacgcttcgttgtatatatagcgcatcggcgcaagcctgaactgccagagtgaccctcccggatcactcatggctgtttatccagcagccaggcctgcatggagcgcacttgatggctagcgataaccttccgtattttttccgcgaaacccaaaccgaccgtacacaactgaccgagcgccaaagcgcgcgccacttcacgctccaggacctcgactggctcgacactgtctatctggccactgatgccttgcgccaggcacaaaaagcgccgatgcatgtgcaaactctgcacctgagcgtacccgatgaacagccgattgaactggcgggcgcgtttgtcatgagtcccgccccaggcgcaggggtatttctctacacacctgctcgaggcctggaaaagctggaaagccgtggggctctcaatacccaattggcaacctggctgaaggatccgctgcagcgccagccgttgcttgattacctgtccattgcccagcaagcgcagctggcgtcggtgacgagcctgagtatttccacccaaaccgtggctggcgctgtcttcgaagcacagcaagcgaccctcaccaacaaccggcttgaaaatgcccgcctgatgcgcgaggaattgctcaatctacccagtttcatgtctctgctggatgaatacatcgccgcacaaatggctcagtccttcgcaggtatcgaccagcgccagactcaagtgcagagcacactcgtcgatacttccagctcctgcggtgacaccgatacgccagcgtcccgacacaccaccatgcgcttcctgcatgaaaccgtgctgatgtatttcgtcgccaatggctggcctaggggagaaacccggcattactccaacccccagcgattgactcagggcgccgatgatcagttgcgctgggaaacctcagtccaagggctggcccaggggctcagcgcatacatgctgcaacagcccaagttgttttggcagcaaccggcttcgaccggaatgacgcgacagcagttgtttatccaagcgatgttccatgggtttctcgtcgccctgctggaccaacaacagcaaggcatcatttcgcctgagcagcgtctgcaactgcaggcgctgccgctcaaggccgaccctggcgcgatcaccatcgcgcccgccctggcggtcgataaagcccttctggaggggccgcgacagccctcgaccgagttggccagcactttgattatccgccatgacaaaagcggcgaggcatcgctctggctgctctatagccctcatctgggcttacaaccgtttaccgagttggactcactcaaagcctaccttctcggtcacctgaacccccagcagcatcccactgcctggagaaactatctgtccagaccggaacgctgcagcgaagtcgacctgcaaaccagcgacatcgcccccgcgcccatcaccgggggtattttccaaagcctcctggaaggcatcattcaaaagcaaggacgcaaccttggatatgcgctggaccagtatcgcctgagccagggcaccctggacctcgacgcgctggtcgaccatgtgctggatgtgcgcggcatggttgatccagcactattgaccctcgaacccatggggcgctggagtacgcagttggcggccgcctggacggcgagtgcgctgcaaccgaggattccaccaacgctcctggcgatgcgcaccacggtgcatttgctcgaaaacgtcgctgccgaaatcgagcagcaacgatcgtcgcgaccctcgctggaacgctcggccattacttatctgaataccaaactgcacagcctcaagctcgcgcacctgcaggctgcgtgcttgtcggtgcgccattacagccgcccctcgagtgccaccggacaacctcagatattgtcatcgagcagcatggtcgagcattttctggcgcgcttatgtggtgaagcaggcccacttaccgactcgccggacacccagctctattcaaccgcacctgacaacgccgccagcaaaatctccggcttggaggtcaagaccttcaatcatctgatcgaaacggccatgggtggttttacccagtatttgcgtcggacccacagcctgtaccccaacatggagccggtgctgagaaaagccatggagatgggcctgatcgcggaaatgcagctcaggctctggaacaacgctgtgttaccgatcgactacgaggtgctgtcgagcgtgctgggtatttatgccagggacctgcgcctgagtgtcaacgggttccgccctgatgcgttttacttgaaggtggcgatcattgggcaagtgacctcgtacgccctcaagaactgcttcgtgttgaccgagcgcggtgggctggacccgcaatactcaggacgcattctgctatggacgcctgcgttggggctggaaggttttcgttcattaagtcagttcaaagcctgcgtggatcaacgcctggcagatccggccgaacgccaggttttcctggagaacctggctcgaccggactggcaggcctacccgacctatgcactcagtagccttgaactgatcgaagacaaccttgttgagcacgttcaacgaacccatgcccaacaaaaagaccttgagctggcacacatcctgtcgatgcagctgtctgcccagcagttgcacaagctatggcaggttcgagtcacgcaaagcctggcgcccaccaatgtgcagcgagccatggacatggcccagtccatgatcgtgcaacatggtctgcagtggttgggccagtccagtgccgtcgatcaacagctctatgccgaactgctggagcagtatcgaaacaatgtgaatgacaaccaggattacctgcacgggatcgactcgctggctcagttcacgcgcaaaaagctcagtgctttgctgacgacgctggacgagcgcatcagcatcagtcctgatgaaatcgaagtaggcctgccggcccagggcgacaagcctgcccgcaatcagccgctgctggcgtatgcactgagtcatcaatcgtattggaaggatgaggtgcctttctttgccggtaccggcacaacgatgctgcctgccaccctggactcgcagacactgaacaatggtatccaggcgctgaagatcaacgaggcctataagacttacatcgaattacgcctgggcgccgccagtgcggacttcgtgcaacgctctactcggttcgccaagcaattgccttggcaactgatgcaatacgctcatagcctgacattgcaaggccagctgtcaccgacggccttcggacttatccagcagatcatggatatgccggatgcgactgcccgggcgactgtagtggatgccgatgccagcatctgtgcgctgcaagtgctgatcgatgccgggaagaacatcctcaaggtgcctggggtgtacttgatcagccgtgccggtgctgacaagacgcctctagttctctatgcgccttatagccctggccatgccctcaaggaatatccggatgaggccgggctcgttgctggactgacatcgccaggcgccttgaagagttggctgttgcaggtgaccccggcagtcgaccaggccacgctgacagacgccctcaaaggcacaggggtgaaactggcttacgacgccatcaacgtaccgctgttcaaacagttgtgcatcgataataccgagctgctgacgtgcctgctgggctgccagaaaaaagccaatgcgcaggcctcctgggagatggtcaaggccgtgttttcggcaggcgtacaggctgccagcgtgttcattcccggcaagctggcttatcccttgatcgtctggcagagcttcaagctgttcaaagacagtgccgatgacctgcaaagccaaaactggcatgaggcacttgggcatttcatcgcaggcgttgccctgatggccagcctgcgccgctccaggcccgccgtgccagaaagcggcagccccccggcgtctcctgactctgcaacggctgtggtgtcgtggcccgcactggatataaccgcggcgcaacgcacccggctacaacgtttcgaagtccttgagccaaccttggccagcctggttaaagacaccgccctcaacctttaccggtccgcttccaatcactactacgcagccgtggcaggcaaagtcttccgggttatcaagctcggcctgggttggcacattaccggcgatgcagaaattggccctttggtgcaaagcaacacgcaacaacagtggatgctcagtagcagtgacccattgctgaccggccgcagagcggttgcacgattgaccaatcgcttctactcggagccctttgcacggcccaatatgaatatattggccattggcatgcgcgatatccgcgcgctttacgcgcaggaatcattgatgatcaccgaggcactggcaatggcgacgttctatgcaaagaacgcccaggagaacgtgcggctgctcctgcaaacgcctcatgccgagcctgaactggtcaaacagatcaaactgttttttggcttgcaggttctcgaggtccagcatcttgaaaaaatccaggaggtcgtcgacaaggtctgcaacgcgttgctggagccctcattgagctcgccgaactcaacgcgatttgtcatcggccgctcacgaatgccggcgctcacgggcacctataaagtgatggcgttcacgatcgtccctgaccctcttcaattgctgtacttgaccgaggctttttttaacccaggcttgaaatacagtcgtctgttaatcaaacctttttacgtcaacgttcatgcgcgtgcgacgacgctcattcacgaaatctctcatcatgaatgtgagacgttggacttggcctacgtgcattccacccaccccttccatgacttgatcgaccctcagacccatgacggcatcagcactaaacgggtgctcgaaaaccgccagctttcgcgactgtcgctcagcacaccggcccatgaattgttccaggttgtggacatcgccaccggtctcaaagcagaccccgcccagggcacgtcaacggcgcctgttctcaaccggctgctcgccgccacgggcacgcaaaccctcagcgatgctcggcaagctttccgcaatgatccgttgaaacgcatcactatagtgctcaacaacgccgactccgtcgcctacttgattacactcttgggacgtcgaaaagccatgcctataagtccaaccagcgactcccgctgatgcgcaatcctcaatgacatcgcgccgagtgaattcggggactgcaggttacccgacagtccgttgagcacttggtggctgccggcggcggttacctatttagcgtcgtttcgcgcggcgcctgattgaggcgtttgttgaactccagccaggctgcgagagccgacatcagcaccacaccgaccagggcggtgagcaactgcatggccatggcgtcacccgccagggcattgagcatatctgccagcggcgccagcaccacacccaggcaaaacacctcgagtgaatagcggcccatctggcagacgcgctcggccagcgggttttgcgtccagccccgttcgggcagcagctttgcggtgacataggccagggcaaggaaatgcaccaggcgcaccggcgacaggtcggtcttgctgatggggtacagcaggttgctgagcgcggtcggcatcactgcgtcatgaacctcaggccagagccacgacagcgtgattacgccagccaccagcacgtacagcgccgctgcgacaaacaacggctgacgcttcaaggggcgcttctctggctctcgggggcgctggctgtagatcgccgcggcgcctcccagcacaaacagcaattgccaggtgaccgggttgaaataccacacgccatcggcgatcgcccgcaggttccagcccatccacggtgccagcaggtacaccaccagcgaaacgcccaccaccgcccaggtagcgcgcaccatcagtggcagcaccacggacaaaccggcaagcaagacgatatacagcggcaacgggtccatcaggttgggcttgaagcgcagcagcagctcatcggtcagcgcctgttgcgggtgggtgacgaagtgcgtcaggcccatctccgccacgaggtcacgggtttccacatggctattggcgaagaacacaatgcccatcaacagtgccagcaggaagatatgcaccacgtacagcacccatgtgcgccgcaggatcttcaagcaggccatccagtagccctcgcgctgcaggactttgccgtaggccagtactgaggcgaagccggcgagaaatacgaagacttccgccgcgtcgctgaagccgaagttacgcaaggtgatcaggccgaaggggttgtggggcacgtgatcccagaaaatgaagatcaacgccaggccccgaaaaaaatcgatgcgcgggtcgcgtccgttcagcatggcagcgggctcttgaacaagttgttgaatgacgataggtgagtgcgcggcttgtcgtacgccgcacatcgggcgggcgcaggttggcggtatttgtaagcaaatgcaaaggatggatattactggatgtctctagacatcaatgatgaccagcgtgccttcgctaccaggcagcactgcatgagcagtacccgcttcgacaaggtacatctggccggcacccactcggatctccttgtcggcgatgctcaagcgcagcaggccgctgactaccagcagcccttcgttgtaaccatgggtttcttcttcatacgcctgctcatccatgcgtaacaccttgatccgcgccgagccgacctgacccaggccggtggatttccagctctggggtaattgctctgcaatggcggcgaagtcgaataacggcatgagaatctccttgttttcaacgatgccgtcggtgatccggttcaacgggcaaatggttactttcagaaagcgtccatcaacaagaacctgcacggctcggcctggtaggcgttgatctgcggcaccaaccgcatgaaatgctcggtctggcagtgcgcatccagcgccgcctgatcgggccattgttcgataaaaataaagtgtcccgggtctttctggtcaacgaacagatcgtaggcgatgcacagcggttcctgacgggttttctccaccagttcggcgtaccacggccgcacggtctccaagtgttcaggccggatgaaatcttcggcgatgactttcaacatggcgggcgtcctcaggcagcggctacttcatggggctcaaaactatccgcccgcgccatctgccacatacgcgaatagaactcgccgttcacttcacctgtgagcaattcgccgggcttcaagaacacatgcagctgcgagaacagcttgatctcggtcgccgacatgcgtcgcaccaggtgtttggccgacaactgcgagggatgatccaggccggcagcggcgagcatttccgccaaggcgtgcagggtgttgcggtggaagttgaacacgcgctgggctttgtccggcaccaccagtgcgcgttggcgcagtgggtcttgagtagcgacgccagtcgggcatttgttggtgtggcacgactgcgactgaatgcagccgatggcgaacataaagccgcgcgccgagttggcccagtcggcgccgatggccaggacgctggcgatatcgaaggcgctgacgatcttgccgctggcacccagcttgatcttgtcgcgcaggttcaggcccaccagggtgttgtgcacaaacagcaggccctcacgcaatggcacgccgatatggtcggtgaactccaccggagctgcgccggtgccgccttccttgccatcgaccacgataaagtccgggaggatgccggtttcgagcatggccttggcgatgcccatgaattcccaggggtggcccaggcaaaacttgaagcctacgggcttaccgccggacagttcacgcaactgggcaatgaactgcatcagctcgatcggcgtggaaaacgcactgtgccgcgacggcgagatgcagtcttcgcccatcatgatgccgcgggtttcggcgatttcctgggtgaccttgtgcttgggcagaatcccgccatggccgggcttggcgccctggctcatcttgatttcaatcatgcgcacttgcaggttctgcgcctgcgcggcgaagcgttccgggtcaaaacggccgtcgctggtgcggcagccgaagtagccgctgcccagttcccaggtcaggtcgccgccattttcacgatggtaggggctgatgctgccttcgccggtgtcatgggcaaaattgccgagcttggcgccctggttgagggcgcggatcgcgttggcactcaacgagccaaagctcatcgccgagatattgaacaccgacgccgagtacggctgcgtgcactgtgggccgccgaccatcacgcgaaaggcactggggtcactcaacggtgccgggcgcatggagtggccgataaattcgaagcccgactggtacacgtcaatcaaggtgccgaagggtttgtctgccgtttcattcttggcgcgcgagtacaccagtgaacgctgggcccgggagaagggcaacgcgtcgctgtcggactccagcaggtactggcggatttccgggcggataccttccaccaggtaacggatattgcccaggatcggatagttgcggcgcaccgcgtgggggctttgcagcaggtcgaaaataccaatcaggctgaggatgccggtgaccagtgtgaagggccacagccattcatgttggataaaggggaggctggcgagggtgaaaatgacgcacacggcaaagaaggcgtaacggcttaacaaagacaggctcatacggttttccttggtttcaactctgaaggtcgattacccattctgcgcctgtcgataaagcacggacaaggattgatcttccggtcgcgtatttgtgcgtgcgaatctttgtacagtaaaaaatatctatcaacgtcatagaggaatcaatgactgcagcgttaccactctttaggcaccttcggcatctgggtgtgaccagatcgcgctggtaggccaaggacgcatttttcgagacggagtttataacgactagaacaagtgatttttgtatgactatattgagcgatgttggtgatagtggacgtatctttaacgcttcagattacttagccgatgatcatgaggaaaaggttgctgcgcatatcgcccaagcgcacaaacggatggaaggtatcgagaagcccgagcaggacgtgcggctaaagccggatttctccacgggccgcccgccgggtgatacccgctccgctgaacaaatcattgaggacaacccgatcctcaagaaccttggtgatgagaaagatatcaatcgttcattggcttataaacgtctgggtgattggaccattaataacccggacccggacgcacgagccgacgcagcattcaacgcagcgagggtactcaactatatcgatacgtcgttatcggcgacgggcaaagaccgtggcaaatcccatgacaatggcgtgcttgaaggcattaccagcagcggcgatgccaggcgtggtacgccggcaggcatgtggaaggactttactgagcagggttataccgccctgcgagacgatcatcgcctcgatcccaccaacgacagctatgtcagggaggacggtacgatcaaaaacgatttccagtggttcgctggtaaggtcggagaatatacttggatgtttcccgggctcagcaatatggccaatgggatcagcaattcggaaccggggataggcggggccatcgagggagccaaggccggttttgacaaaacccgggctgatggtttggataaggcccttgccagtgctacgagtggcgactacaagggtatcgccgaagcctatgccgatacggtgcgcaataacgagtccacgccggaggtggtcaagtcagcattggatgctgtgcgcagttaaggccgttgggttaaagcggctggggctcctatgaggtgggcttgattcaccgcgttttccgggcaaacccggcgagcgggcgtttcgtgggtcacagcttctgggagcccccatagacctttgcgctttaccaatatcgcaattggttctcgtttggaagcgattttgtgtgttactgtataacactaaatacatccagactccccggaggccttatgaaagctggtatccatcccgactatcgcaccgtgctgtttcacgacactgccgccgacgttttcttcctgatcggctccaccgccgacagtgatcgcacctacaagcacaccgatggcaatacctatccctacattccattggacgtgtccagcgcatcgcacccgatctacaccggccagcagcgcaagacccaggccgaaggccgcatcgccgggttcaacaagcgtttcgcgtcgtttggctcaagcccgaaaaaagccgagcaatgagtatgagccggcggcgtgccctacgccgccgtctgccgaatcggcaggaccacccgaaatgtggtgcccttgcccggttcgctgctgactgatatgtcgccgtggtgtttcttgacgatgccgtaggacagtgacaatcccagccccgtaccttcacccaccggcttggtggtaaaaaacgggtcgaagatcttctgcatggtctgcggggcaatcccgcaaccgttgtcggccacttccagccagatgttctcgccttccacgccattgctgatggtgatggtgccgcgctctgggcccatggcttgggctgcgttgatcaccaggttcatcactacctggttgagctgcgaggccaggcattcgatgtctggcaagggcgcatagtgcttgatcacgtctgccttgtacttgagttcgctggcgacaatattcaatgttgaatcgatgccgtgctgcaagttggcgaactgccaggtctggtcgttatccactcgtgagaaattcttcaggtccttgacgatctgtaccacgcggccaatgccctccttggattcgcgtatcaggatcggaatgtcctccctgagaaagtccaactccagcgtcgtgcgcagtgcctggagttgatcgcgttggtcctgcgccgtaatgaacgcttcgctgtgctggtaggcctcgagcatctgctgcagtcgattgaagtaactgtcgagggtactgaggttggaggaaatgaagcctaccgggttgttgatctcatgggcgactccggctgcgagttgccccagtgaggcgagtttctccgattgcaccagttggctttccaacagcttgcgctcgtcgatttccagttgcagcgcctgggtgcgctgtgccaccagttgctccagcttctcggtttgcagggaggcgcggcgggccatgtcccatttgttggccagagtgttggccatttgctggacttcaatgttgtcgaagggttttttcaggatcagcaagcgctcgtgggcatgcaggcgaaacagtaggtcttcccaggagtaatcggagtacgcggtacacaccaccacttgcaggtcgggggcaactttccacaattcttcgatcgtgcgggcaccgtcccagccctgaggcatgcgcatgtcgacaaaggccaaggcataggggcgtttttcggccatggccgtggtcagcaagcccaggccttcttcgccgccataggccgagtgcagctcaaacgcctgggcctggggtttggcggtttcaccaaacagggctgattccatcgcgtccaacgcctggttggattccatcgcaggcatcaggatcttgcgaaaatcatcatgaatggatggcgtgtcatcaatcagcaggacgcgccggttgggcggttggttcatggggttgttccggcgtgggtgagagggatggtcaaggtaaacacagcaccacggcccggcccgtcgctgtgggcgctgagctggccattcatttccactgccgccagggcgcagctgtgcaggccgaagccatggccttccttgcgcgtggtaaagccgtgggtgaagatccggatcatgttttcgggcggtatcccttcgccgtcatccttcacgctgatcttcaaggtgtcatcagcccccggcagcaccgtcagggtcatctggcgtggccggtcgctgaggccggtcatggcgtacttggcgttgctgatcaggttgaccatgatcagcagcagccggtgcttgtcgccgagaatctgcggcacctgcgcgtactccttgaccacggtgacgtgatgacggctcagggcgccggcgttcatgcgcagggcgtcgtccatcagggcgccgatgtcgacgggttcgagcagtgatgaggccccggcgtaggactgttgggtcgagacgatgtccttgatgtggtcgacgctcttgctcaattgcgtcagctcatcggccatgccttgctgttcaagcgcaatcgcgtccaccagttggttcaagtagcccggcagcaatttgcctttggcatcctcggtaaggaaggtacccaggtcgccggggtgctcgttgagcaattgcatggccttgcccaggccccttgccttgctattgcgcaatgtgcgcgtgaccaggtcggcggagatattcacgctgttgagcacgttgccgacattgtgcagcacgttggtggcgatctcggccatgccggcctggcgggcgctgtccatcagctcgctctgggcatccttgagctgttgggtgcggcgttccacccgttgctccagggtttcgttggccgcctgcaaggcgcgattgacccggttgatctcggagaaactgcgcaacagccgcatcgccaggtagagcagcaacaccaccagcaaggtcgagaagatcaacaggtagcgatggtattggtgatcgatgaggtcggcggtctgctggtcctggttgagatgggtggtcagctcatccaggcgctcgcccaccgggacggctgcgatctgctcaagcaggctgttgaccagtggctgctcgcgcaggatcagcgagatgtgattgctgaggatctccaccggcgcctggaagtcgctgggcaggctctctttgttgatcgccagcttgcccaggcctaccaggatatcggcagcgcgctcgtcgctggtaacctgggcaaactccaggctgctgagcagcaggtcgtaggtgtcggtggccacgccttgcaggcgcagccggccttcatcgtcaatttcattgaattgggcctggatatcgtcttcggccgtcggcagaaaggccagggagttgcgcaataccgcgttgtgggatttgaactggtccaccaaccgcgccttttcctgaatggcggcctgataggcctcctggctgctgcgccaacgtggcaggtcgacagggttatggaaggtgtcacggctttgcagctcagcccatatccgcgtcatttccgccagcggcgtgaccaggggatcgtagttgtgggtaatcgcgatccgcgccttgagcacttcgctatcccactgggcattgagttgctggagctggcggatcaggtccctggattgggtgtagctggccgtctggtcgcgggaggacttcaggtacaaaaacaccagcgtcgaggccagcagcagggttatcaggcccagtagcagttggctggtgcgacggcgggacagcggcgagcgcaatttcatagtggcttgcccgcccattcgccggtcaaggtcttgagaaactggataatcaggtccttgtcttcctggctcggcgtgcgtcccagctggtatttgaacatcacgtcgacggcctcttccagggtcttggccgaggcgtcgtggaagtacggcgcggtgaccgccacattgcgcaggctgggtaccttgaacacatgccggtcttcttcatcctgggtcaccaggtagcggccaaggtccgattccagcgggttgccgcgggccttgaaatagtcgcccatcacgccgaacttctggaacatgttgccgccgatattcaccccctggtggcaggcgatgcagccgtagtccttgaagcgctggtagccgtacttttcctggatcgtcaggatctcggtattacccagcaggtactggtcaaaccgcgagttgggggtcagcagcgtacgctcataggtggccagggcgtcttgcacattggcggcggtgacgccgtcggggtatgcctgcttgaacgcgttctggtagacgggcagggcggacaggttctgcaccacggttttccagtcactgcccatttccagcgggctgatcaccacgtgttcgacctgcgcttgcagggtatcgacccggccatcccagaactgcttgaagttcaggctggcgttgaacacggtgggcgtattgaggggcaccggcttgccgtcaaagcccagggagaaggctttgtcatcggcaccattggtttgcagatggtggcagctggcgcaggacagcgtgttgttgaccgacagccgtggttcattgaacagctggtggcccagttcgacctttgccgggtcaagtgtcgcaatggccggcaggggcttgagcgcttcgtccaacggtgcggccatcaagggcaccgccaggcccgaccccagcagccatatcaggccgaggcggcaaatcgagacatcgctcaagcgagcactccttgcaagcaatgggttattgatcgggcatcagtgttgcgccacccgcttgcagcaactgggcgaaatcctcggccggcaaggccttgctgaagagaaaaccctggccttcctcgcactgctgggcttgcaggaatttcaactgttcaacggtttccacgccttcggcgatgatgttcagctccaggctcttgcccatgccgatgatagcgctgatcagttgtgcgtcctggttatttacactcaggccgcgcacgaaggattggtcgattttcagcacgtcgatgggaaagcgccgcaggtagctgaggctggagtagccagtgccgaaatcatccagggccaggcgcacgcccatggccttgatccggtgcagcctctctacagtggcatcgacgttctgcatcagtacgctttcggtgatctccagttccagcagggtaggtggcaggccggtgtgttggaggatgacggccaggttgtcaacaaagtcgcgctggcggaagtcgatggccgagatattcaccgagatcggcaagggcggcaggcccatggcccgccatgcctgggcttgttcgcaagcctggcgcaacacccattgggtcaggcgcacgatcagcccactgtcttcggcaaccggaatgaagtccgccgggctgatccagcctgcacgcggctggaaccagcgggccagcgcttcggcaccgacgatgcgcccggttttcagcgccagcttgggttggtagtgcagagtgagttcatcccgctccagggcctggcgcagcgcgctttccaggtgttgctggtgctgggcgcgccggttcatgtcttcggtatagaagctgaagtcgttcgggccacgctccttgctggtgtgcatggcagtttccgcatgcttgatcaacgccaccgcgtgggcgctgtcattggggcagatactgatccccaggctggcggtgatgctcaggtcatgccccgccacgtggcgagtcacgctgaccgccttgagcaccttctgcgcaatatgctgggtttgctggggatgctggatgtcgttgagcaggatcacgaactcatcggagccataacgaaacaccgagtccgaggcccgcaccgtcgtcgccaggctttggctgacctgctgcagcagctcgtcgcccaccgggtaacccagggcgttgttgatgcgcttgaagcggtcgagcccgaggaacatcaccgccagttgcgtgtcgtgccgccggcccaaggcgatcgcctgggtcagccggtcgcccagcaaggtgctgttgggcaaagccgtgagcgcgtcgtattgcaacaaatgcgagaccttgagcagctcttgcacacgttcctcaatggtgcgttccaggccgatcaccttgagggctacatcctgggccagttgccatttccaggtcagggcgctggccatctggcggatttccagggggtcgaagggctttttcagaatcagcaactggtcgtcgtatttcagccgcgcttcgatggcttcgaaggagtagtccgaataggcggtgcacagggcgatttgcaggttgggatcggccgtccacagctgctcgatggtttgcaggccatcccagccaggcggcatgcgcatatcgataaacaccatggcgtagggggcattggcggccagggctgtgttgaccagcgccagtgcctcctcgccctggtaggcggagtcaagctcgaagccgtggcgcaccggcgcagtcgtgccaaagagggtggactccaggctgtcgagggtttgctcaccctgttcatcggcacacaggatcttgcgaaagtcctggtggatcgaggcggtgtcatccacgatcagaatgcggcggttggcccgcacagccttggcgttcatgatgcgctcggtaatggtaaacggcttgatagcataacgcttccttccctggtcctcgctcgagcggggcgcgaactgactatgacagcatagtcgagctcccttgatatcgacggccagttggcgtcaaatcaacagcgattgctgtatgaggcccgtcagcgacggagcacggcacgatacaacggctcaatgtagcccaacttggttttattaaggcagagttaccatggatgaaccactcgctaccaagccggctgtgctgcttgtggacgatgaagagtcgattctcaacagcctgcgccgcctgctgcgtagccagccctacgacgtggtgttggcgaccagcggcgcccaggccctcgagatcatggccggtcggcccattgacctggtaatgagcgatgcacgcatgcccggcatggacggggcaacgctgttggccgaggtgcatcgtctgtatcccaccaccggtcgtatcctgctgaccggctacgctgacctgaccaccatcatcaaggcaatcaacgacgggcagatccaccgctacatcagcaaaccctggaatgacgaggagctgccgctggtgttgcagcaggtcctcgagcatcagcgcctgcaacgcctggcccacgggcagaacgagcagctcaaggtactcaacgctacgctggaaaaacgcgtggtggcgcgtaccgctgaattgcagcagaccgccgacatgctcgacctggcctacgacgagctcaagcgcagctacgtgaccggcaccgaagtgttctcgttgctggccaacctgcgcttacccaaggacaaacagaccaaccgcgccttgatcgagctgatccgcgtgtactgcgccagccaggccatggacgaagccagtacccgcgacctgaccatggccgccgcgttatacaatatcggcaaattgagctggaccgacagcatgatgatcgcgccatcggacaggctgcacagtaccgaccgcgggctgtaccgcgagtacccgacgcagagcgaatcgttgctgatgaccctggaaccgatgaaggatgccgcgcgtatcattcgtcatcaccaggagcgctgggacggcagcggctttcccgatcacctcaagggcgaggcgatccccgccggttcgcgcctgctgaaactggcggtggacttcatcgagctgcaaaaaggcctgatcctcgagcggcatttgaacagcgacgaagcgctgctgtatatccgcaagtacgccgggcgcctttacgacccgcaactggtcgaggcctttgtgctggcctgcgccactttcctcagcgacgtgaccctgggcgaccccaacgtcaaggtcatgggcacccgcgaactggccgaaggcatggtgctggcgcgcaacctcaatgccgacaatggcatgttgctgcttaatgccggcaaggtgctgaacttgccgctggtggacaaactgatcgcgttcgaagccatggagggcgccaagtacagtgtgtttatccgggtgccggaggaagcgccgccgttgccgtagtggctgcggggctacacgccccaggccacgtgcttgctgccgtgatagtcaaagatgccacggatgatgtagacatccttgccgccttccttgccgttttgttctatcgccacacgccacagaccacgccccgagccggcctgtacctggggtagatcaacataggtgtagttgttgatccgcttgcggctcaggcgcccggcctggatatcctgggtgatctgctcgagcttggtcatggcgctatcgggcaggagtcttttctgggtctgtgccaactcatccagcttcacgatattgatgtccgggtcacgggccgggatggcttgcgtgaccgacggcgtggccggcctcgggcgttgggtcctgtgggtttgaacgcgcggtatttcaaactccaggggcgtggaaaatttcggcagttcccgttcgaattgcgtgacggtgcggctgtcgaccatggtgacgccagcgtcagcgtcgtgcttgccccgtgacatggcaatgtagggaatgccggacttcttgaagtcttctgaataagaggtgacctgaagcctggcgagttttgccttgaaggtatccttcatgaagtcatccagggttttcttcacatcgggccgcaatagaaactgatgcgccgcctgttcgagggggatgttgatgtcggcggccagtttgaaaatctgcgcgcgacgtgccggttcgttggcgaactcattcagcgccgcctgttgccaggtgtagagctcatatttctgcgcaaatcgctccatcgcattctggtgtttttgcgtgatggcgtagccgacgaattgcgcctcggtgtcggggtcgataatggatatcgaggtgcggatctccttggcgaaattgtcgttcttgccaatcagtcgtttgacctgcttgaacagctcatccttgtccgcggcggacagcggtggcgtcaggctgcgggtcgacttgtggatgtgttcgtacgcggccaggtcgaagcgcagggtcagcacggacgtgcgtagtttttgttgattggctgtgctcaagctgtagggtctggacagccagcggcgaaactcagcctcatccacattcgtgcccagttgctggcgtgcgcgggtgatgaagttgagtttttgcgcggcgctggtttgtctgatgacctcttctaacacccgcatctctgcttctgtggcatagacctgcatagccaggatcaggtccgcatccacttgctgttcaggggtgagagggcgcaaggccccgagaaccgggccgccgcccctggcgttgcgttcgaaccgcggcttccagcccttggcatctgcgggcacgaccataaagtccacgtggttccccgccgggtcgcgtacatagcgtgcgccgtcctctacataggacgggtacaagtaatagcggcctgcctgatcgcgcatcgcaatgcgttggttattgtgcttatcaaaaaaatacggcgcgctgccggtttggcgcgacagcttgtagcggttggcctgggcaaaccccgcaaaattgaaaaacggcccgatctgctcgggtaaccgataaggcgtcacatccacccaggcgggttccagcgggcgcacggaggtcgcggccagcgtgacgcgggttttctgggcagcgccgattttcttcgccagccccggtactcgctgccctagctgcctggccaggcccagcccgcgttggacaccgcggcgcagcagcgacagggtggctttgccgggaaccaggccaagcagggtatcggtagcctccacgcccaacatgaaggcgttcaccgccgactcacgtgagacctcggcattgctgcgtgagcggaagtcggcgtgggccagttgaaaccccagctgcgccgaatacaggtacgcgtggatattcccgctgatgggcgtcaaggcataccggtgcacaccgcgggtatcgttgaagatgcgcttgatttcttcggcatcctggatcgccatgcgcggcctgaaatacgcctgccattcgaccctggccttgagcgtgtcgagctgcgccaggcccttggtgagttcacgcacgggtatgccatccggggcgtccggcgtatacagcaggctgacgccgtcgggcttggtgcccttgcgctgaatcaccagcacgcgattgatcacctgcccaccttggcccctggcctgcgcgccgcccatgaccagcaggttgacctctatctcgtgatcgctgacccgggggcggttcgttgagtcggggtattcggtaaccgccttgatccagtcgcggccgctgccgggggtacggaaagtaaacagcgcgtcagcatcagggttgagtcggctctccagagcgtccttgttcagttgtgccgcacaggctgcctgccaggcaatggcaaaggtgcttcccgcgccatctgatgcgaacgcgttgcgcaggtagttggcgtagccctggccaatgtcggcctcttgggcgagcgcacgcagatcttcagtgccgagcttgcctcgatgcacgccggcggtgtcgaagatattcgcgctggcgctgacccgagtgagtagggcgcctacggaaaacgactcgacattgcgtcgggcatagctggccagtgtgcgcaggtcgacaaggatcgaggtgcgccaggtgccccatgtcacctgtttaccttgcaggaactgcgggatgtcgatcttcgggtcttcgctgacgtagacaatgccgctggcctcatcacgataaccgcgcacctcagccgacctcgacccctgttcggcggacacacgcagatgtaccaggcttctgtacgggtcgatctccacgtcggcataaacgggtttttgttgtttcagcaccttgtcggtctgcgcttcggcgaacgtttgcaggctcgagatggtttccagcagcggcaaaagcaccaggttgctgtcgagcagtgccttgtccaattgccggtagcgggcttgatcctgcacgctggcggttttcaaccaggcgggttcggcgtctatcaggcgtaggttgcgtgcaacgaaagcgacagctacatccagttgcggggccaggtcaatcgccaggtcgagctcaccggcctggggcacgacttcactgcgcacggcatgacaggccgcataatattggcgcacgcgcaatgagtggacgctgtgggcaatcacgtcggcgctgattcgcaccggttgcgtcgacagcaccggcaggccggtcaggctgctgcgtgcggctgcggacaggctggcaaccagcagctttgcggccggcccgtcggcctggattcgcgccgcgatggtttcattcaagcgctgcaggttgtcaaattcctcgtattcctcgctcgcgctgtacaacagcaccttgccagtgggcggtgtgtcctgggtggggctaaggataaatgccccggcgaactcactgccatcggccagcgccaggcggtaggccgcgggtctgctgctggcgggtagcgccagttcccgcgccgcgtcactggggtacttgagtactgtttccgccagtgcctgtgcgctggccgacaacgtgccgtcaagcacgcgcaacgccagttgatgggccagcaccttgcggcgcaagtcgaccagttgtgcttgcgggttggcctggggcggctggtcgctggtccagaatgtattcaggctcaaggtaatggcgacttccagccggctgggcagggtgataattccggctgtggaggccaggcgtttgtcggcgtccagcgtgtcgcgttcgcggtagaaagcgccgctttgcgcgctcaggtaggcttctgcgccaggctcacgcaacctcttgagcaacatgcccaggggctcgcaggacagcagttgtttttgtccgtcctgatcttcgcggtagcgactgtaaaagatctggttagcatcgatgggccgatgcagttcggggaacatctcggccaaatgttgctggtacacaccgcccgcactcggttgttgctgtagcagttgctgggtctgggtattgagcgtgtcgagggctcggatgaggtgggccgactgctcgtcagtggacagcgaagccggcggcatgacgggcagcgttactggctgtgcggtcgcgtcgtcggcctgaggttcgtcagcagtgggttccggggttgggggcgatgaaataggcatgggcaaactcgtcaaaaaggggcacggcgctacatcgatgcggcgcgccgagggcaataggagtgtgcgagtctagggttgccgatggtggggacggcggtgcatgtatgtcggcaaggttgtgtgggctgcaagcccatgggatccttggcgactttcagaacctgggggtgctccatgtccaagactatccgcattgccgctgccatcctgatcggcagcgacggccagaccctgctggtgcgtaagcgcggcacccaagccttcatgcaacctggcggcaagatcgatgcaggcgagcagccggtgcaagccctggcccgtgagctgcgcgaagaactggacctgcatatcgacccaagtaaagccacgtacatcggcacattctcgggaccggccgccaacgagccagggtttgtcgtcgaagcccagatgttccaattacggatcgacgtggcagtgacccccgccgcggagatcgaagaagtgcgctggatcgacccggccggcgacggcggcttgcagttggcgccgttgacccgtgaccatatcctgccgttttaccgcgcttcactgaccgcgccggcctgaggcgcgcaattgggtcgatgcgggggcggggctgcgggtggcgaggatccagttgatgcaccactgtgtaaatgtgggagctggcttgcctgcgatgagcatgggtatctacacaactgagtagcatccgacgctaaccacgatgcgcagcgagccgctcttgaacttgatctgcttttgatcttaggcgcccgttaaaccacgctggcggattacgggcacaccgagcctgggcgaggtgccgagtggtgggggcaagcacctgcttaacgcaccgcgctgaccccatccaacgtggaaaacgacgtgtccttggccgtcagcaggaagtcgcgcatatacggcgcgtccagcatgtccgcccgaatcccggcatacagcgttgcaaacaagcctttctcgcccaggcgcttggccttcacgtagccgcgtgaactgtattcatgcaaggcccagtggggcataccgcacacgccgcgaccgctggccaccagttgcatcatcatcaccgtgagttccgaggtgcgcacctgggccggctcgacgtcggcgggttccaggaagcgcgtgaagatatccaggcggtcacgctccaccgggtaggtgatcagggtttcggtgagcaggtcttcgggcacgatatagggtttgtttgccagcgggtgctggttggccacggccagcatggcttcataggtgaacaacggcacgtaggtgataccggccagttccagcggatcggaggtcaccaccaggtccaggtcgccgcgggccagggccggcagtggcgcgaaggcgaaacctgaagccaggtccaattcgacttccggccaggcatcgcggaactggtcgatggtcggcatcagccattggaaacaactgtggcattcgatggccatgtgcaggcgcccggcggtaccgccggccaagcgggcaatatcgcgctcggcgccacgtagcagcggcagggtggcgtcggccagttgcagcaggcgcaagccggcgctggtaaagcgcagcggcttggtcttgcgtacgaacagcggcatgcccaggcgctcttccagttccttgaattggtgggagagtgccgactgggtgagatgcaagcgctcggcagcctccaccaggctgtcggcttcgcgcaaggcgtgcagggtcttgaggtggcggatttccagcacgatggcctccatgagcagaatttgtgatcaatggtaacccattgagttctgctcatgtttacctggcccctgtaatagagggctattggaccgcgctgaaatgtttattggcgaacggcttaccgatgttgccacgccagattttcaggtcggcgaaggttacgccgcgtccttcggcggccatttgccaatgcaggcccaggtaacgttggcgcggtattttcaaatgccccgcgacgaaactgtcgagcgccgagtcggccagcgtgtagtgcgagtgcgcataccatgccggcgtgtccggggcctggcggtcgtggttgccagcggatcgcttgcgctgggggagaacaacgcttgttgccggtcgagcaaccagcgttccatgtccgtgcgtcgggtgaaggtatgccaggccggtgcgagggtcggcaggtacaaaagttgattgaccggttcctcgttatccacggtcagcacccaggcgccgggcagggcaatggtgcggcggccggcggcatatagctatcgacacgaccgttgagcgatcttcattaaactgtcatgcaactgtggcagcgcgcttgaacaaacttcatcagactcgcgctctactggggttctgcgttttggtgtttttcatgcgtgtgttgcttttactggccgctctcttgttcggcctgccgtcttttgcggcgtctcgatgtgatgtcaatgttccgacccaaacggtcgacctggaacaggtgagcatcgcctaccagagcatcggtcgtgcctccgacccggccctgctgctggtgatgggcttgggcgggcagttgatccactggcccgatgaagtggtggtggccttgtgtgaacaaggttttagggtcatccgttatgacaatcgtgacgtgggcctgtccacttggcgccaggcccccgccagcgccaacctgacgttcgaagtgctgcgctacaagctcggcctgccggtggctgcaccttacaccctgacggacatggccgatgatgccctgggcttgatggatgcgttgcaggttcggcaattccacgtactgggcgcgagcatgggcggcatgatcgcccagcatctggcagcaatggccccgcagcgggtggaaagcctcacgctgatcatgaccagttccggtgccgagggcctgccagcgccgaacgcggcgctggtgcaattactgtcacggcgcagtgcgcccaatcgtgaggtggcgctggagcaacaggcggatttactcgccgccctgggtagcccggatgtgcaggatgatcgccaggcgctgttgcaccaggcggcgctgtcctacgaccgcgccttcaaccctgagggcgtcaagcgccagatcatggcgatcctcgccgagcccagccgtgtgccgttgctcaaccaactgagagtgccgaccctggtggtgcatggcactgccgacccgttgttgccggtgatgcatggcgtacacctggccgcacatattcaaggcagccagttgaaattgattccaggcctggcccaccgttttcaggaggcattcaaggcgccgttgctggcggctgtattgccgtacctgcaagcccatcgtgaagatgccgcgcactgggcgcagattgaccttggcgagcctgcgaagctgttgtgaagttggtgtatcgtgcaacctttatggcgcacatttaatgccagcgaggttgcctgcatgagtactcccctgaaaatcgatttcgtcagcgacgtgtcctgcccctggtgcatcatcggcttgcgtggcctgaccgaagccctggaccaattgggcaccgaggtgcaggccgagattcatttccagcccttcgaactgaacccggacatgcccgccatcggtcagaatatcgtcgagcacatcactgagaagtacggctccacgcctgaacaatcccaggccaaccgcgagcgtatccgcgacatgggcgcggcgttgggctttgctttccgtaccgatggccagagccgcatctacaacaccttcgatgcccatcgcctgctgcattgggcggggttggaaggcttgcagtacaacctcaaggaagcgctgttcaaggcttatttcaccgatggtcgcgacccttcagaccacgcgaccctggcgatcatcgccgaaagcgtcggactggacctcaagcgcgccgcccagattctagcctctgatgaatatgccaccgaagttcgcgaacaggagcaactgtggacctctcgtggcgtgacttcggtgccgaccatcgtgttcaatgaccaatatgcggtgagcggtggccagccagccgaagcctttattggtgcgattcgccagatcatcgaagaagccaaaaactaaagccaaagccggggcaccgctcatagccctggcccgccccttgcatcacccccctgaagcccagccggcctgcggttgggcgctgccattaggggtgaaacattaccttgaacattcttgacctcgaccacagcctcaccggccaggcacccattgcccggcggttggccagcggccgggccacgcgccttgatctgctggacctgggcccgaaactgcgtttgtgggccaccgagaaaacctggaagcgctttgttgcgcgcctggcgcaacggccacggcccagggatgcgcgcccggagatcctgtttgttggctccggtgactatcaccatctcacgccggcctttttggccgacctgaaagaacccatcagcctgatccacttcgacaaccaccccgactgggtgcgctttgcgcccaagcgccactgtggttcgtgggtcaaccgtgcgctgaagatgccggcgatcaaacgcatcgttaccctcggcccgtgcagtgatgacctgcacaacccgcaactgcgcggcggcaatctcggcgccctcaagcgcgggcacttgcagttgtttccctggcagcatccgccgtcgaaagtctggggccgggtaggcgacggtgccggccaccagcaacaggaaaaccacctgcactggcgcaacctggcggacctggactgggcagcgttcctcgaccagatgatcgccagcctgcccaccgaagcgatctggatcaccatcgacaaagatgtgctggccagcgaagacgccgccaccaactgggaccagggcggcatgcgcctgacccacttgctccaggccctgcgggcgttggcggcgcataaacgcatcattggtatcgatgtgtgcggtgagttcgctgtgccggcgttcagcaacgcgttcaagcgctgggaagccaagtccgaccagccgtcaccggagcgctggagtgcgcaggatctgcagcgcaatgccgcgaccaatgaagccttgatcgacctgtttgaggagctgttcccatgaccctgaccgtggtgttgttgctggccttttccatcgtcctcgatgtgatcggccagttgtgtttcaagttgggcgtagaccgtttgccccagctcgatggtggctttcgactgcgcgcattctggggccaggtattcaatgcgccgctgctctgggctggcgtcggggcctatgtcatcgagttttttgtctggctcgaggccttgtcccgtgcgccgttgagtctgttgtttccgctggcggcattggcgtattgcctggtggtactggcgggcagggtagtgctcaaggaaaccgtcagccccaggcgttgggtgggcacgctggtgattaccttgggcgtgatgttggtagcgattgcggggagccaggcatgacgacgcaaacaagcgatagcggttggttacatgggcgtcttggcaccctgatgctgtgggcgctgctgatcgcgaccgaaagcgccgggcagttgtttaccaaggtggccggtgatcagttggggcagatggacttcacctggcaatggctggctgacgtggcgcgcaacccggggatcctggcggcgattgccagttatctcggtgcgttttttgtgtggatgctgatcctgcggcgcagcagtttgtccttggcatttcccttgagttcgctggtgttcgtggcagtgttgctcgggtcgtggttggggctgggggagcacatcagcctgttgcattgggtgggcgtggtggtgattgtcggtggtatcgcgcttttggctgagggcgaagagcactgaaaattctgctgcgcaacacaggccaaatgtgggagggggcttgcccccgatggcggtgagtcagtcaattaatcagttgactgacaccctgtcatcgggggcaagccccctcccacatttggatctgctgacttaaggcagaactgcgtcggcttttaatcgaaggtgtagctgatcgccgtctgcacctgaccctgattcacgtcgccagcctgcttgacgatgctgctcttggccgccgaccccaccagatgcacccagctggcactggtcagcagggaccagtggggcgccagggggaaggcgaagctttggctcagcgtcacgttctggaaaccgccgctggcgttgtagggccgaaagccggtggcggcggcttcgttgctgtcgacgccgaagtaggtgttggcctggcgcgcatcggcaaaatgcgcgaccaagccgctgctgccgatgatcccgccacccagcgggtagcccagttcaccgccaattttacccagggcgccgctctgggaatgcccgccgcccacggcctggcccagttgcgcgtagacgcgccagaaattggccggggcgtactggataaaaccgccgacctcggccatgtccgacacgttgcgcaaaccctgcaactcgccgttggaagtacgccccgccaggtaattgatataggggccggcggtaaggccgtggctgttcagtgcactccaggtcaggccgtcatcggtgctcaggctgacgtctccccagtccaggtccaggtagggcacgggccgggtttcgtagcggctgccgctggggtcatggggctgatagctcaggcctgcgcccacgtcgccgctgatgccgtccgcccacgcggcactggaagcgctgcacagcccaagtagaccggtgaatacagcagatgtgagcttggacatggtgcgttttcctaaggtggacaggcgcgcatgaacgcgcaaaccctcgcttctgcgcaagcactcatcttgtttgtagcaagctacaaaaattgtagctcccaagacacgttgtcctctgcaaatcctgcaaaccccccggcctcactgggttttgcccagttggcacagtccctgctctatcccaggtgcaagcgcagacagcgcgctctcttaggtaaaggcagatgatccactggcatatcgtgtgtgacttcgatgggaccattacccccacggatgtcatcgacaacgtcctccaacgcttcgccggccccgagtgggaaaccatcgaacagcaatggctggatgggcacatcggttcacgcgaatgcctgagccgccaactggcgctgatcaaggcgaccccaagtgaactgctggcgtatttcgacagcgtcgagatcgacccggacttcccggatttcgtcgaccacgtcatggacctgggcgcgaccatcgaagtggtcagcgacggcatcgaacaaggcatcgcccgcatcctgtcgcgccactacgtgaccctgctaccgatcctcgccaaccgcgtgcgccaggtcgaccacaacagctggcgcatcgacttcccctatgccagcgatgcctgccgcgccgcgtccggcaactgcaagtgcaaatccaccccgcgcaacaaacgcgtgctggtgatcggcgacggcaagtcggacatgtgcgtggcctccaccgccgacttcgtgttcgccaaaggcagcctcgccgaatactgcgtcgccaaccagatccctcacgcgcgcttcgaaacctttgccgaagtgcctgcattgctggccaagctgccacatggcatcgccgccaacgccaccaccttcaatacctctgctgacaatcaggaactcttccatcatgtctgatatccgtatcgctaccgccgaagaccaggttctgctggataaggaagccaagtactgctcctacggcgacaccgttcactacatcgaaccgccgcgcattttcagccgctgcgaaggctcctatgtgtgggacaccgaagaccaggcttacctcgacctgcaaatgtggtactcggcggtcaacttcggctatgccaacccgcgcctgaacaacgcgctgaaaaagcaaatcgacaccctgccgcaaatcgccagccagtacctgcacaaaggcaagatcgagctgtcggaaatgatcgcggtcgacgccaagaacaagttcggcctcgacggtcgcgtgcacttcaacgtcggcggttcgcagtccatcgaagattccctgaaagtggtacgtaatgccaccaacggcaagagcctgatgttcgccttcgaaggcggctaccacgggcgcaccctcggcgcctcgtcgatcacctccagctaccgctaccgtcgtcgctacggccacttcggcgagcgtgcgcaatttatcccgtttccataccacttccgtggcccgaaaggcatgaccaaggaagagtacggcagccactgcgtgcagcaattcgcccgcctgttcgagaccgaatacaacggcgtgtgggacccgaaagtcggccagagcgaatacgctgcgttctacgtcgagccgatccagggcaccggtggctacgtgatcccgccgatgaacttctaccgcgaactcaagcatgtgctggaccagcacggcatcctgatggtgtccgacgaaatccagatgggcttctatcgcaccggcaagctgtggtcgatcgaacacttcgacgtacaaccggacgtgatcgtgttcggcaaggcgctgaccaatggcctcaacccactgggcggcatctgggcccgtgaagagttgatcaacccgaagatcttcccgccaggttcgacccactccaccttcgcctcgaacccgttgggtacggcggtgggcctggagatgttcaagatgaccagcgaagtcgactacggcgcgatggtcatggccaagggcaaatacttcctggaaggcttgcaagacctgcagaaacgcttcccgatcatcggcgacgtcgatggcctgggcctggcgctgcgttgcgaaatctgcgggccggacggcttcactccggacaaggcgaccctggactacatggtcgaagaaggcatgaaaggcgacatggtggtggacggccagaaactcgggttgatcctcgatgtaggcggttactacaaaaacgtaatcaccctggccccgtccctggaaatcagctacccggaaatcgacctgggcctcaagctgctcgagcaactactggtgcgagcgacccagcggtgagtgcgcacggtattgacctcggtgaaggcgatgccggtttcgtactcggtgaaggtccggtcgggatcctgttgatccacggcctgaccggcaccccgacggagttgcgccaggtcgccaagggcctgaccaaggcgggcaactgcacagtgtatgtgccgacgttggccgggcactgcggcgacaacagcgacctgcaagccaccggttggctggactggtacgaaggggtgcgcaagaccttcgtacaggtcaggcaacgccacgagcaggtgttcgtcggtggcttgtccatgggggcggtgatgtcgatgtatgtcgcatctgaacacccaggccaagtcgccgggctgctgatgtattccaccaccttgaagtacgacggttggagcattaacaagctggcgtttctcacgccgttgctgatgaagattccgttcggtgtgcacatttgccgcttcgaagagaagccgccctacggcatcaagaacgagcgactgcgggccatcgtcgagcggcagatgaaggaaggggaaagcagcgaggcggggttgctgaccatggaaggcatcacggtgcgcgagttgcaccgtatgaacgccgtggtcaagaaacgcatgccccaggtcaaggtaccggcgctggtgttgcactccatcgaggatgacatcaccagccgctggaacgccgactacgtggagcgccacctcggcggtccggtgaccaagatcctgctggataactgctatcacatgatcaccgtcgacctgcaataccgacgggttatcgagttgagtgccgagtttatcgggcagcacgcggtgcaactcaatcgtgtggcctgatccgctgacctgtaggagcgaacttgctcgcgaagggtgttaaagatagcgcgtactgccaggctgaacgcggtatctgtgcgattttcgcgagcaagctcgctcccacagtggggcggtgttgataaggaaaaactgtgctaaccacccaagccttcccgaccatccgcgccatccagcgcgatgcctggaacgactgttttcccggtgccctggaggattgggactattacctggccgtggaaaacgccgcgatcgatgactttcaatggcgttacctggcggtctttgacgatcaaacgctagtggctgtggctgccgcgttcatcacccattatcgcctcgacaccaccgtgtcgggggccggcaagcgcttgaccgagcgcctggaccggctgtggccgggtgctttgcaactggcgttgtacgccatcggttcgccggtggctgagcgctgtgatgccggggtcgccagccatgtgtccaaggcacggcgcccgttgttgctgcaacagttgctgacggctgcgcgtgccgacgccgatcaactcggtatcgggctggtggcggtcaaggacgcgccgaccaacgacccgcattgggctgaaagctgccgggcagcaggttttcaaaatatgccgagcttgcctactggtgtgttaccgctgccctacggttcagtagacgcttacttgggttcgctgggcaaatccactcgcaaggacctgcgccgcaaactgcgcgcaccggggccgcgggtcgagtggcgccgcaacatcgatgatgtgctgcccgaggtcatgcgcctgtatgaagcgacgctgacgcgcgcggacctgcagttcgagcgcctgcccgccggttacttcacccaagtactcgaacaactgaacgagcgggcggtctgtgttctttactgggtgggcgaacacctggtggcgttcaacctgatcctgctggacgagcatcggctggtggacaagttctttggtcacgacatccagttcagccgcgaatacaacctgtactttcgcagttggctgaccaatgtcgactattgtattcaacacaaaatcccgctgtacgagtgcggccaggccgggtatgccagtaaactgcgcctggggtgcgagttccagggcaacagcctgttctttcgccaccgcaaccggctggtcaacggcttgctcaagcttgtaaaactgtttattcgaccggatcgttccgaccctgccatggctgctgcgataagcgaaacctgatgatcaccaagacccgccagaaagcccgcccctttgccatttcgcgttggagcgtccagcgcaagctggtgctggcgttctggctggtcagcgttattccgaccatgatcgcggccgagctggccgccaccacgctatcgcagattttcgacagcaacgtacgcatctggctgcaagagtcgaccaagatcgtcaaggacgagatcggcgacatccttcatgacaacgcgcgcatggccaagctgtttttgcgttacaccagcccgccgtcgtccaaacaagccgccaagcatgaccggctcaccgccgatatcgccgacgccaccgatatcgacgtggtggcgctgattcgcaccagtgaccataaggtggtgttcagcacggccgccgatgacatcgtcaggcagatcagcctgaccagcaatgcggtgctgcagaccgtgcaagtcgccggggtgagtaccggcctggtggtgtcgaccttcgaaaccagccgtgacggcgttgattacctgctgctggtggctacctacctggatagcagtttcctgaccagcgtggccgatgtgcattccctcgacctgcgtctttacctggccaaccccgcaggcttttccgaaatattttccacccagcgcttcgagaatcacccctcgcgcatcccgaaaaacgtcgaggctgcactgcgcagtaccaaacaacccagcgagcagttcaccaaccagtacagcgggttgtattggccgatcttcaacgatgctggcgagctgcaaggggtgattttcagcggactgctacgtcataccagcctggtggggctggtgaaccagagcaacctgttcgtgctgattttcctgcttagctcggccctttcgctggcggccgggttgctggtgtcgcggcgcctgaccaagccgctgcgggacctgtcccagggcgtggacgccgtgatctcgggcagttacgcccaccgtgtggtggtcagcggtggtgacgagctggcgcagctgagcagcaccttcaatcacatgaccgagcgcctgggcgagttgcatcacctcgaagcccagttgcgccggcgtgatcgcctgcatgcgctgggtgaagtcgccatgggcctggcccacgaaatccgcaacccgctgggcatcatcaagaccgccacccaactgttgcaccggcgcgccgacctcgcggacgccgacaagcgccacctggaatatgtgatcagcgaggtcagccgcatcaacgacctgatcaccgagttcctcgactttgccaagcccaacccaccgatccgcgtgttgcagccggcccgcgccttggtggaagagatcctcggtttctgcagcccggagctgagcagccacaacatcgatgcacagatagacgaccaggcgcctgacgccacgatctatgcggacgccaagcagctcaagcaggcctgcctcaacctgattcttaatgctatcgatgcgatgcccgaaggtgggcgcctgaccctggggatccgcagcgtcggcgataacacggtgatcagcatcggcgataccggccagggcattgccgcggatatggtcgagcgcatcttcacgccgttcgtcaccaccaaggcgtcgggcaccgggctgggcctggccaaagtttattcgatcatggaaagtcatgacggcagcatcgaatgcgccagcgagaaagatgccggcgccacgttcagcctgtacattccggctaacggtgaagacgacggcgaagatgaggacaggcatgacgcataacgtattagtggtggatgacgagcccaaactgtgtgacctgttgtcgtccgccctgagccagaatggcatccaggtattcagcgcgggcaatggcctgcatgccctcaaggtgctgggggatgaggacattgacctggtcatcagcgactggcgcatgccgggcatggatggcccggcgctgctggccgagatcaagctgcgctacccccaagtgccggtgatcgtgatgaccgcctacagcacggtgaaaaatgctgtgcaatcgatgcgcaacggcgcctatgactacatcgccaagccgttcgatatcgacgagctggacatcaccgtggccaaggccctgcaatttcgcgacatcatgcgcgataacgcacgcatgcgcgccgaactggacgagcacgcacagtttgacagcctggtcggcgacagcccggcgttccgcaaggtattgcaggcggtggattcggtacgagacagcagcacgaccatcctgctgaccggcgaaagcggcaccggcaaggaaatggtcgcccgcgccatccacaagcacggcagccgcgccgacaaaccctttgtggcagtgaactgcgcggcgattcccgaaggcttgctggaaagcgagatgttcgggcatcgcaaaggcgctttcaccggcgccgtggcggaccgggtcgggcgtttcatgcaagctgacaaaggcacgttgtttctcgacgaagtcggggatatgcccctggcgttgcaggccaagattttgcgtgccttgcaagagcgggtgatcgagccggtgggcgaccctcgggagcgcaaggtcgacgtgcgagtgatcgccgccaccaacaagaacctgctggacgcggtggccaacaaagagtttcgcgaagacctgtattatcgcctcaacgtcttcccgattccgctgccggccctgcgcgagcgcgtggaagatatagcgcccctggcccggcacttcgcccagaccttgagcgccaccgccggcaaacgcatcaccggtttcagccccgaggcgttgcaggccatggcggcgtatcactggccgggcaatatccgcgagctgcagaactgcgtggaacgcgcgaccatcgtggcggcgtcgccggtgatcgaggatattgatttgccggggtatctgtttgcttccaagccaagtgagggcggggtgacggcggtcctctgcgacgggccgggcgtgccgcgggacctggatgcggcgttggcggaggtggagaaggcctacatcctcgcggcgttgcaggagagcaatggcgttcaggccgcggcggcacagcgcatcgggatttccgagcgcagcttctggtatcgcctgaagaagctaggaattcaagtagacaaaatagtccgctgacacaccgctattggcggcaagccccctcccacatgtttgaccgagttgagtcaggtatggaggcgtacccacacgctgaccagcaccgtcgcggccatcaaccacgctacggccgccacagcgagtgacgcttccagccgcatccgatccaccatcacatacaaggtcgccaaatacacaaagtaaggaatgatcgaccacatcccgaacacgatggtggtcttcaagtcctccaccgaacggcccttgccgacgatgtaatgggcgatcagcgcaaaggtcggaaacagcggcaccaatccggcgatgtaataatttttggttttggccaacgccgccaggatcaataccaccgccgcgccaagggcggccttcagaacaagatccatcagtggctcaacccgtatttcttgaccttgtcgaacaatgtggtcttggccatgcccagttcctggctggcctgggtcaggttgccgccgctgcgttgcaacgcgtcgctgagcaggttgcgctcaaaagcttccactgcctcggtaaaggccaggccctggttaccgctgccggcgccgcttttcttgaaggcgggcaggccgagggcgaagcgttcggcgacgttgcgtagctcccgcacgttgcccggccagtcgtggctcatcaggctggacaaggtctggttatcgaggtccggaacgctgcggtcgaagcgcagtgacgattgctgcaggaagtgttcgaacagctgcaggatgtcttcgcgccgctcgcgcaggggcggcagttccagggtcaccacattgaggcggtagtacaggtcgctgcggaactggctggcgcggctcagttcgtcgaggtcggacttggtggcggcgataacccggcaatccaccgccacgctctggttcgaacccaggcgttccagggtgcgctcctgcaagacccgcagcagtttgatctgcaggttgatcggcatgctttccacttcatcgaggaatagtgtgccttggtgggcgtgctcgatcttgccaatgcggcgcttgccggcgccggtaaaggcgttggcttcatggccgaaaatttcgctttcgaacaggttctccggcaagcccccgcagttcaaagcgacgaactggtgggaatggcgccggctgaaatcatgcaggcagcgcgcgaccaactccttgccggtgccggtctcgccttcgatcagcacgttggccgaggtgtcggcgacgttggcgatcagttcgcgcaggttttgcatcgccggcgagcgaccgataatgcggccttccaacgagtcgcgctcggccagttggcgacgcaacgaccagacttcccgcgccagcccacgctgctccaaggcgcggcgggcgacttccaccaagcgttcgggggagaagggtttttccatgaagtcgtaggcgccgttgcgcatggcaccgaccgccatggagatgtcgccgtgcccggtgatcagtaccaccggcaggcttttatccagggccttgagtcgggtcagcagttccaggccgtcgatgcccggcaggcggatatcactgatgacgatgccggcgaagttttcgccgacgcgatgcagcgcctcttcggcactgcccacgccgatgctgggaatgtcttccagcgccagggcttgctggcagccgagcaacacatggggatcgtcctcgacgatcagcacggtgaggtcgtcggtcgcagttgtagtgtctgtattcatgtcgactcggtttgttgagtgcccaccagcggcaggctcaggacaaaggcagtaccaccaccggcagggtgctccacggcgagattgccgccggtggccgccgcgaggctggccgatagcgtcaggcccaggcccaggccctgctcgccaggcttggtggtgaagaacggttcgaacaaatgcttgcgcgtctcggggtcgatgccatggccgttgtcacgcacccgcaggcgatatttgccatcgacgacctggccttccagccatagctgcggtgccggttgcgcttgcatcgcatcaagggcattgccgatcaggttgaccaggatctgctccaagcgcgtctggtcgatctgcaattgggcgttgctgaagtcacggtgcaaagtcaacggcaggccgtccaggcgtgcgcccagtacctggaacgcggcgtccacggctttgccgaggttggcttcgccctggtcgtcaccgcgtcgggcaaaggagcgcaggctggcggtgatgcggcccatgcggtcgatcaattcgttgatggccttgaggttggtactggcggtgtccagggcgccgcgctcgaggaaacgcaccgtgtttcccgacagcgtgcgcagggccgccagcggttggttcaattcgtgggcgatgctggtggacatctggccgatggccgcgagtttaccggcctgcactagttcgtcctgggcgtggcgcagggtttcttcggcttggcgccgttcgcggatctggcccttgagccgttcgttgctggcgcgtaggtcggcggtgcgttcggcaatccgtcgttccagctggctattggcctcctgcagggcttctcgggcggcgaggcgggtggcaatgaccttgcgccgttcattccaggcaatcagcaagaaggccaccaggccaaaggcaacggctaccaggatgccctggttgatcgcggcacggcgcaggtcgttgagcggggtgagcaaggtgaattgccacggtgtgtcgttgagcggacgggtttgcgccaggtagctgacggcgtgctcgtcgttgaccacttcgctgttggccgggaaggtcagtttctcggtgccctcgttcaggcgctcacgggccaggggctgcagttcgttgagcgtcgcccagtaatattgcaggctgtgggccaggcgttccttggtgtcttcgctcagtgggcgtacggccttgaggcggcgggccgggtcgctggagaggatgatgatgccgttctcgtcgcttacgaaggcttcgaggcgggcgcgttgccagcgttcttccagggcttcgaggcggaccttgaccaccgcgacgccgatgatcttgccatgctcttccaggccatgggccaagtaatagccgggttcgccgttggtgctgccgatgccatagaaacggccgggctggccgcgtacggcattctggaaataggcgcggaaggacaggtcttcaccctggtaactgtcggcatcgcgccagttactggtggccagcacgcggccggtggtgtccatcacgtagatggcccggctgcgactgcggcggttcaggccctcgaggtaagcattgaccgtggtgcgggtttcctggttcgggtcggccagcaaccgcgaaacgctcgactccagctccagcaggctgggcaggtaggtgtatttgctcagttcgctttcgacggtgcgggcgtgcagctccaactggcgttcgccgttgtcgctgagggtgcggatgccatagtactcactgacccagaagccgatataacccaagccgaccatcagggcgatgatcaacggcggcaggaacagttggcgtatcagacgaggcttcacggcaagtgatggcggcgcggcgcgatattgattggggtcgcatttcatcacagatgccttgggtcaaccagagctgccagcctgtgtggtccagtgtgggagggggcttgccccccctcccacattggcccggtttctacagtaggagctgtgtacttagctaagtagtacttagtgctgcaggattttctcaaggaagtgctgcgcacgttcggagcgagcgctgatgtcgccgaagaactcttccttcgggcagtcctcgatgatcttgccggcatccatgaagatcacgcggtcggctactttgcgcgcaaagcccatttcgtgggtcacgcacatcatggtcatgccttcctgggccagttgcaccatcacgtcgagtacttcgttgaccatttccgggtccagcgccgaggtcggttcatcgaacagcatgacgatcgggtccatggccagtgcgcgggcaattgccacacgttgctgctggcccccggagagctggccaggatgcttgtgggcgtgtgccgacaagcccacgcggtcaagcagctgcaggcctttcttggtggcttcttccttgctgcggcccagcaccttgatctgcgcgatggtcaggttttcggtaatggtcaggtgcgggaacagctcgaagtgctggaacaccatgcccacccgcgaacgcagtttcggcaggttggtcttcgggtcggcgatggaggtgccatcgaccactacgtcgcctttctggaacggttccaaagcgttgacgcacttgatcagggtggatttgcccgagccggacggcccgcacaccacgatcacttcgcctttcttaacctcggtgctgcaatcggtcagcacctggaagtcgccataccacttgttgatgttcttgatagagatcatacggcaaaccttttttgcagacgcttgaccagcagcgaggcggaaaagctgatgatgaagtagacgacaccggcaaagatcaggaactcattggagcggccgatgatgtcgccgttggagcgggcggagttgaggaagtccaccaggcccacggtgtagaccagcgaagtgtcctggaacaggatgatcgattgttgcagcaacagtggcgtcatcttgcgaaacgcctggggcaggatgatcaggcgcatggtctgcccgtaggtcatgcccatggcttgtgccgcggccatctggcccttgggaatcgactgcacgccggctcgcacgatttcgcagaaatacgcggcctcgaacatcatgaacgccacgacgcaggaggtgaacgcaccgatgggagtgtcttcgccggtgatccagcgcagcacgaacggcaccgccaggtagaaccaggtaatcaccagcagcagcgggatcgagcggaagtagttcacataggcgccggccacacgcgacagcagtttgctggacgacaggcgcatcaacgcaaggatcgtacccaggatgatgccgccgaccacgcccattaccatcaactgcagggtcatgaccatgccgttccacaggcccgggatggcggggatgatgccgctgaaatcaaagtccattatttaccccccacggagatcaggccgggcaccgcgactttcttctccaccacgcgcatcagcagcatcaggctcatgttcagggtgaaatagatcagcgtggccaaggtgaaggcttcgaacaggttggccgagaactcggcggtctgcttggtttgcgccagcagttccatcaagccgatcaaggacgccacggaggagttcttgaacacgttgaggaattccgaggtaagcggcggaatgatgatgcgatacgcctggggcagcagcacgttccagtagatctgcggcagcttgaagcccatggcgcgtgcagcggactcctggccacggggcagcgcctggatgccggtacgcacttgttcacacacacgggcggcggtgaacaggcccaggcacacgacaacgctcaggtaggccgaggtagtcgggttgaggtcttgcttgtaccagtcctgcaggttctgcggcagcaggtcgggcaccaggaagtaccagatgaacagctgaaccagcagcggcacgttacgaaacagttcgacgtagcaggtcgcaatgcccgatacgatgcggtttggcacggtgcgcatgacccccagaatggagcccagcagcaaggcgatgatccatgccacgacagcgatggcgatggtccagcccaggccggcgatgtaccagtcgagatacgtctcgctgccaacgccagtggacttgaagaacacgccccagtcccagttgtaattcattagggtctcccctcgagatcgatcaatgtacaagcacccgcttggggaagatcctttcccacctggcaatgaatgccaggcacacacgatcggctcggaaaccgccaggtcgagtgttccaaattaaagccagcaggtagtaacagatgcctgagggaggttggctccctcaggaataagcttagtcaggtatcagatttttacgtcaggcgctggtttgtcgcttgggttagcgatcagctccttgaccttgtcactcatcgggaagttgaggttcaggccttttggtggaatcgggctttcaaaccacttgctgtagatcttgttgatctcgccggatttgtacagggcgacgatggcgccatccacagccttcttgaagtcagggtcgcctttgcgaaccatacatgcgtaggcttcaaaggactgcggagtaccggtgatgacccagtcgtccggcttcttggccttggcttcttcaccggcgagcagggcgtcgtccatcatgaacgcaacggcacggccgctttcgagcatctggaaggactcgccgtggtctttggcggagatgacgttcatgcccatctgcttgtcggcgttcatcgccttgatgatgcgctcggacgtggtgccggcggtggtcacgacgttcttgcctttgaggtcggcaaagtcagcgtaggacggcttgccatccttgtctttcttgaccagcaggcgagtgccgatttcgaagatgttgacggtgaagtcgacttgctgggcgcgttcggcgttgttggtggtggagccgcactcgaggtccgcggtgccgttctggatcagcgggatacgtgtttgcgaggtcaccaggttgtacttggctttgaggtcgggtttgttcaggtcttttttcagctgttcaacgacggccaactgaatgtcgtgggagtagcccacgggtttgcccgaaccgtccgcgatgtaggaaaacggaatggagctgtcgcggtgagcgagagtgatggtgccggagtcgttgattttcttcagtgtgccggtgagttcggcggcgaaaactggagtgctgatcagagcagcagcaatagctgcgcccaggatatggggaacgatgcgcatcaatacttcctcgacatttgttttttttatgaagccagctaaacggctcttttgtacagcgaatgcccgagacggctcctaaggcgcctcaggtaatcgtcaaagagtgtagagcatgagtcgtgccataccgaaaataaaaggttaactacatgatttatatcgggattaactttatgttacgacgcggttttcgacgccgggtccggcaaaccgaatagggcgggagcttgcgttcggaaaaccgaatgccgcccaggtcatctgcgggagcgagcttgctcgcgaaaacgcaaaagcgccgcgtttattctgaataaacgcggcgctctcaggtttctcgcgagcaagctcgctcctacagtttggggatggctatcaggccgcttcgatcttgctacggctttgttcgaccttcgccaggtagcgttgcacgttgtcctgctcctgcggcgtggtgaacaggccaagcttggtacggcgccacagtacgtcctgcggttgcgtcacccattcttcggcgcacaggtaatcaacttcacgggtgtacaggccgccacccaggtggtcaccgaggtcggccagcgattgcacgccctccagcaggcgccaggtgcggctgccgtaggtggtggaccagcggcgggcgatttcgctcgggatccagtcgaacttggcgcggatcgcatcggccagggcttcgggcgtggtcatgttttcaccgccgggcaggctggccgtggcggtccagcttgggcgcatctgggtgaagtacggcgccagctgggccatggccgattctgccagcttgcgataggtggtgagcttgccgccgaacaccgacaggatcggcgcttcgccgttgctgccggacagcgccagagtgtagtcgcgggtgatggccgacgggttgtccgactcgtcgttgcacagtgggcgcacgccggagtaggtgtggacgatatcgtcacggctcagctgtttcttgaagtgcgcgttgaccaccttaagcatgtagtcggtttcaccttcggtaatcgctactttcgccgggtcgccggtgtattcgcgatcagtggtgccaatgatggtcaggtggttcaggtacggaatagtgaagacgatgcgttggtcttcgttctgcaggatgtgcgcgtgggcgccttcgtacagtcttggcacgatcaggtggctgccctggatcaggcggatgccgtagggcgaatccagcttgaggtcgtccctgatgaacttggcgacccacgggccggcagcattcaccagtgcgcgggcgcggatcgagaacaggctgccatcggcacgttccatgttcatttcccacatgccgttgctgcgatgggcgctgatgcaacgggtctgtgtatggatgtgtgcgcctttttcacgggcagccatggcgttgagtaccaccaggcgggcgtcatccacccagcagtcggagtattcgaagcccttggtgatttcgcttttcagcgggctgtcggcgccgaatttgaggcttttggaacccgccagtttctcccgcttgcccaagtggtcataaaggaacaagccggcacgaatcatccaggccggacgcaagtgcggacggtggggcagtacgaagcgcatctgcttgacgatatgcggtgccttggccagcagcacttcacgttcggccagggcttcacgcaccaggcggaattcgtaatgttccaggtagcgcaagccgccgtggatcagcttgctgctggccgatgaggtgtggctggccaggtcgtccttttcgcaaaggaataccgacaaaccgcgaccggctgcgtctgctgcaatgccgacgccattgatcccgccaccgattacggcaacgtcatagacttcggcaagcggtggagcaggcaaggtggaagggttcatcggctagcctcgcgatcttttcgtcttggaattcgaacattaatgttcatttgcgaaaatggtagctgataaatgcgaacacagccacccaacttcgattaaaaaaactcatcgaagggtgggaaaaggaagatttatgaacatgagcctggggaaggctcaaaaggttgagtgctggatagatcgccatcgggagcaagccccctcccacattggtagtgttcacagctcaaaatgtgggagggggcttgctcccgatggcggcagtgcaggcgctacacgacttccagtcgcaccttatgctcattcaacaactgcaccaacgccggcactggctgctgatcagtcaccaggcagtccaccaggctgatcggccccaggcgaatcatggcattgcgcccgaacttgctggagtccgctgccaggatcacctggcgtgcattggcaatgattgcctgggaaacccgcacttcctggtaatcgaagtcgagcaggctgccgtcctcgtcgataccgctgatgcccaccagggcaaagtcgaccttgaactggttgatgaaatccacactggcctggccgaccacaccgccatcgcggcgtacgttgccgccggtgagcaacacatcgaagtcgtccttggcactgagcatcgtggcgacgttgaggttgttggtgatgattttcagatggttgtgattgagcagtgcgcgggcgatggattctgtggtggtgccgatattgatgaacagcgaggcgtggtcgggaatttgcgcggcgatggcttcaccgatgcgctgtttctcgtcgcgcatctggtctgcacgcatggcatatgcggtgttctcgacactggagtcataggccgcgccgccgtggtagcggcgcaacagattggcgtccgccagctggttgatatcgcggcggatggtttgcggggtaacgacgaatagctgcgccatttcctcgatactgacatacccgcgttcgcggaccagttcgaggatttgttgctggcggggaggcagattcatggggcgtcctttgggctgccatacaaaagtggcccatgatgacgcaggaatcggctccctgccagttacaacccgatatggaaccggtgcttggcttattcagcgccttcgtgcggttcccagtcgcgggtgcggctcaccgctttttgccagccggcgtagagtttttctttggcggcttcgtccagttggggttcgaattcgcgctcgatcacggccttgccacgcagttcgtccaggctgccccagaagccacacgccaggccggccaggtaggcggcgccgagggcagtggtttcgcgcatttgcgggcgctcgacctgggtgccgaggatgtcggcctggaattgcatcaggaagttgttggcaaccgcaccgccgtccacacgcagggccttgaggcgttcgccagagtcttgttgcatggcgtcgagtacatcgcgggtctggaaggcaatcgactccagggctgcacgaataatgtggtctacgcgtacgccgcgggtcaggccgaacagcgcaccacgggcatacgggtcccaatagggcgcgcccagcccggtgaaagccgggaccaggtacacgccgttgctgtccttgactttgccggcaaagtattcggtgtcgtgggcgtcattgatgattttcagctcgtcacgcagccattgcacggtggaaccgccgttgaagaccgcgccttcaagggcgtaggccacttcaccgcgtgggccgcaggcgatggtggtgagcatgccgtgcttggatttcactgccttgtcgccggtgttcatcagcaggaagcagccggtgccgtaggtgttcttggcctggccggcttccacgcacatttggccgaacagcgcggcttgttggtcaccggcaatgccgccgatggcgatgccgctcttggtgcggccatagatttcggaggaagacttcacttgcggcagcatttcccgcggcacatccagaatctccagcatcttcgcatcccactccagggtgtggatgttgaagagcatggtgcgcgaggcgttggtgtagtcggtgacgtgggtcttgccgccggtaaacttccagatcagccagctatcgatggtgccgaacagcagttcgccattgcgtgcacgctcgcggctgccttcgacgttatcgaggatccacttgagtttggtgccggaaaagtaggggtcggtgaccagcccggtggtgtcgttgatgtactgctcgtggccgtcgcgcttgagctgctggcagatttcggtgctgcggcggcactgccagacaatcgcgttgtagatcgggcggccggtgatcttgtcccagactacggtggtctcgcgctggttggtaatgccaatggcggcgacctggtcatggtgcaggccggcttgcgccagcgcttcgaccattaccgcgctctgggtggcaaagatttccatcgggtcatgttcgacccagccggcttgcgggtagtgctgggtgaattcacgctgggcggtgcacaccacgttggcgtcacgatcgaagatgatcgcccgggaactggtagtgccctggtcgagggcaatgatgtagttcttattctgaatgtcggtcatgtcaggtgccttacgaaataaggaagtcagaaatcagcctgggccgcgaagggcagggggccaggctggcgctttcaggaaatacgggtcttgccgttgacagccgtgtcaggtgtttcagctatagcaggtgcggcgctcggcaggtgacgggcaatcagcccgcgataggctgccgcgccgaggcatgcgccgacaatcggggcgaaaatcggcaccaggaagtaaggaatgtcgcggccaccagtaaaggccatttcaccccagccggcgaaaaaggtcatcagcttgggcccgaaatcccgtgccggattcatcgcaaagccggtcagcgggcccatggcgctgccaatcacggcgatcagcaagccgatcagcagcggagccagcgggccgcgtggcaggccgttgttgtcatcggtgagggccatgatcacacccatcaggatcgcggtaatgaccatttccaccaggaaggcctgggccgtgcccagcagtgcatgggggtaggtggagaacacggatgccagttccaggctggcctgggagccgcggaccatatggtgggtttgttcgtaatcgaaaaacaggttgctgtagagcgtatataccaaggctgcagagcagaaggcgccggcgacctgggcgagaatatagaagggcagtttgcgcttttcaaaatcggcaaaaatgcacagggcgatactgaccgccgggttgaggtgagccccggaaataccggcactcaggtagatcgccatgctcacaccgatcccccagataatactgatttcccagaggccaaagctcgcacccgcgaccttgagcgcggcgacacatcctgtaccgaagaagatcagcagtgcggtccccaggaattcggccatgcattggctcgaaagtgaaggctgttgaagagcagttgtcatggcaaacctcgattgttgttcttgtctggcgcactgcctcagcgggcggttgcgcgattttcaccgtgacaaggatccccatcctgggtcgcggcttactgctggagtactgaggagtattcctacagtattcggaaacgaaaaaatatagacaagaatgaccgctgtcaaaggtcgaaagtgaaccgccagtcactttctaactattggtctgatgaatgatcatgcgggttaggtttggcctgtgcgccagcagcgcttgaactagagcgttttgcctgcgcttggcctagaattgggtgcctgttttccctgcccggagactccatgacgcccgcattggatttgttgaaaaaagttcgcgccgaacatcgcatccatagctatgaacacgacccgaaggcggcttcgtatggcctggaggccgcggaaaaattgggtcttgaccctgcgcaggtgttcaagacgctgttggccagcagcgagaaaggcgaattgttggtagcggtggtgccggtcgtcggaagtctggatttgaaagcgctggctcatgcggcaggcgtgaaaaaagtcgaaatggccgatccggcagcggctcagcgttccaccggttacctgttgggcggcatcagcccgctgggacaaaagaagcgcttgcgtacgtttatcgacgaaacggcgcgaccctttgcaacgatttttgtgagtgcggggcggcgggggctggaggtggagttacccgcagctgtgctggccgaacatacccaggccaagttcgcgccgattggccgggcctgactttcagccctgttacgattcaaatgtgggaggcggcaagccccctcccacatgtttaacccggtttcctcagaaagctgcttacgcctggaacagcaccagatgctcagcagccactcgaatccctacatccgtccccatctgttgatcaacatggctggggaaaatcgattccagctgtgcacccgttggcagttgcaaccggtacaaggtcgaggctccctggaacgtcttgccgacgatccgagctttcaatgcgctgtccggcgcgtagacgatatcatccgggcgcagcaaaacatccaccgcgccgccgatggcccaggtataggcgcgattaccacgcaggtcacccagctcggtgctcactgactcgggcgagttcaattgaccccggatgaaatagccctggccgataaaactggcgacatagggcgtctgcggttcgtgataaaggttgtagggcgtgtcccactgctcaagacggccctccttgaacacgccgacatggtcactgacggcgaacgcttcttcctggtcatgggtaacgaggatcgcactggtgccccgcgccttgaggatatcgcgcacttcatggctgagcttgcggcgtagttcgccatcgagattggaaaacggttcgtccagcagcaacagttgtggctccggcgccaaggcgcgggcgagggcgacacgttgctgctggccaccggaaagctcgtgtgggaaacgcttgcccagatccttcaggttgaccagttccagcaactcggcgactacacgatccttttgcagatgtttgcgaataccgaagccgatgttatcggccacgctcaggtgcgggaacagagcgtagtcctggaacaccatgccgatacgacgtttctcgggtgccagggtgaaccctgcgctggagatgacttcgccggccaggctgatttcgccttcatgtatcggctcaaagccagcaatggcgcgcaaggtggtggtcttgccgcaccccgaggaaccgagcaggcaaccgatgtcgccggcattgaggtgcaggttgaggttctgcaccactcgttgatcttgatagccgcatgccaggttgcgcaggttcagcagaagtggctggctcatgcgtggtggtacgacggttcgacgagaaattccagcagggctttttgcgcatgcaggcggttctcggcctggtcccaggccaccgaacgcgggtcgtcaagcaggtcgaggctgatttcttcgccgcggtgggcaggcaggcagtgcatgaacagcacgtccggcgcggccgtatcgagcagggcgcgggtcacctggaatggtgcgaacagggccaggcgtttggccgtttcgtcttcctggcccattgaggtccagacgtcggtgctgaccaagtgagcgccgactacggcatccttggggtcgcgtagcaattgcacacggccatcggccttggccatgaactcggcgctcggctcgtagccttcagggcaggcgatacgcaggtggaagtcgaattggatcgccgcctctatatagctgttgcacatgttgttgccgtcgccgatccaggccacggtcttgccttggatcgagccacggtgttcaaggaaggtttgcatgtcggccagcaactggcaggggtgcaggtcatcggacaggccattgatcactggcacgcgagagttggcggcaaactcggtcagggtgctgtgggcgaaggtacggatcatcaccgcgtcgagcatgcgtgacatgaccctggcgcaatcgctgatcggttccccacggcccagttgggtgtcacgcggtgacaggaaaatcgcctggccacctagctggatcatgccggcttcgaacgacaggcgggtacgcgtcgaggatttctcgaaaatcatcccgagtacacggtttttcaaaggctcaaacagtacgccgcggttacgcaggtctttaagctcaatgcctcgacggatcacgctgaccagctcttcgggcgtgcaatccatcagggagagaaagtgccttgcgctcatcattaactacctttttgcaacagaccgcagatactcaaagccttgtttattgtgacaacgggcgagacctgcggcggaagccgcacggggcgacgaaataggggaaggcgcgatattgacattaaatgtcgcgtcttaccaatagggctacggtttttaggggtgttcaagcagggcgctgacgcgcgtttgaagacgatttcctgacagcagcgggtcatttgtacactggcgccgaggccttttgcaatgcgccgaggcgggcccaagccaggtagcgtcggtttaagccgctggatggacggtttctgaaacatttactcatgcttagccatgccctggcctatgcccaccgattcacagcacgaaggttgctggcgcgctggcagctcgccgcccatagttaagccaaagcccctataaaagagactggccatgaccaagactctccatcaccgtgcctgccacctgtgcgaagccatctgcggcctgaccctggaaaccacccaggctgacgatggcagcctggcgatcacctcgatcaagggcgaccccctggacagtttcagtcgcgggcacatctgccccaaggccgtggccctgcaggatatccagaatgacccggaccgcctgcaccagccgatgctacgggtcggcagcgaatggcagccgatcgcgtgggatgaagcgtttgccatggtggccgaacggctggcaagcatccaggcccggcacgggcagaacgcggtggcggtgtatcagggcaaccccagcgtgcacaactatgggttgatgacccacagcaactactttctcgggctattgaaaacgcgcaatcgcttttccgcgacctcggtcgatcaactaccccatcacctcaccagtcaccttatgtacggccatggcctgttgctgcccattccggacatcgaccataccgacttcatgttgattctcggcggcaacccgctggcctccaacggcagcataatgaccgtgccggacgtagaaaaacgcctcaaggccattcaggcgcgtggcggcaaagtagtggtggtcgaccctcggcgcagcgagacagccgccatcgccgaccagcacttgttcgtacgccccggaggcgacgcggcgctgttgttcgggctgctcaacaccttgttcgctgaggggctgacccgcgacagccatttgccagttgaagggctggaggacgtgcgccgagcaattgtgggattcagcgccgaggcaatgagtcgccagtgtgcagtgcctgccgagcagattcggcagttggcccgcgatttcgctggcgctgacaaagccgtttgctacggccgaatgggagtctcgacccaggcgttcggcaccctgtgtcactggttggtgcagttgatcaacctggtaactggcaatctcgaccgcgtgggcggtgcgctgtgcaccagcccggcggtcgacctggtagcctcgactggtggcggccatttcaatcgctggcagagccgtgtgtccgggcgcccggaatacggcggagagttgccggtgtcggctctggccgaggaaatgctcaccgaaggcgaaggacagatccgcgcgctggtgacagtggccggcaatccggtgctgtcgacgcccaacggtcgccagttggagcaggcgctggatggattggagttcatggtcagcgtcgacctctatatcaacgagaccacgcgttatgccgacctgatcctgccgtccacctctgcattggaaaacgatcactacgacaccaccttcaatatgttcgcggtgcgcaatgtcacccgcttcaaccgagcgatcctgcccaagcccgagggtgcgctgcatgactgggagatctttgtcggcttggccaaggcattcgcggcgcagaccggcgtagcgctcaagccaaccctgcctccggcacagatgatcgatttcgggctgcgcgcaggcgcctacggtgatgcatccagtcataagctatcggtggcgatgttggccgatcatccccatggcgtggacctggggccgctcaaggccaatctcgcagtgcgtttgaagactgccgatggcaaggtccaggcggcaccggctgtgatcctcgctgacctggcgcgcttcgaggcgcagccggtgccggtggccgacgagctgctgctgatcggccgtcgtcatgtgcgcagtaacaattcctggatgcataactaccatcggctggtgaagggcaagccacgccatcaattgctgatgcatcctgacgacctcgccaggcgacagctcaatgacggtcaacgggtgcgggtaagttcgcgcatcggcatgatcgaagtggacgtgttggccagcctggacatgatgccgggcgtggtcagcctgcctcatggctgggggcatggccgcccgggcgtacaaatgagcatcgccagtgctcagcccggggcgagtgccaatgacttgaccgacgagcggcagttggacgagttgtcgggtaacgccgcgcttaatggcgtgccggtgcaagtggcggcggcgtgaggtgcccgagcaccgcgctgggattttgcgttacaatgcgccaccgtgccgacctgtgagtcgcaaagttccagccgaggtgttccatggatatcatcgaaacgatcaaagaccagattgccaacaacaccattctgctctacatgaagggcgcgcctaacgctcctcagtgcggtttttccgcaaaagcctcccaggccatcatggcgtgtggcgagaagttcgcctacgtggatatcctgcagaatccggaaattcgcgccaacctgcctaaatacgccaactggccgactttcccgcaactgtgggtagccggtgagctggttggcggcagcgacatcatcactgaaatggcagccgatggttcgctgcaagcgctgatcaaagacgcagcggaaaaagcggcagccaagactgaagcttgattgaccggcaataaaaagccccgcttctcaatacgagagcggggcttttttgtacgctaggagttattcacccatctgcgattgcaggtagttctccaggctgaccttgtcgatcaggcccagctgggtttcaagccagtcgatatgctcttcctggtcttccaggatgtcttccagcagttcacggctgccgaagtcgcccttggtttcgcaatgggcgatggcggccttgaggtcgctatggctcttgcgctcaaagcccaggtcgctgctgagcatttcctgggtatgctcgccgatgttcagcttgcccaggtcctgcacgttcggcaggccttccaggaacaggatgcgtttgatcagcgcgtcggcatccttcatagccttgatcgattctttatattcgcgcttgccaagcttttccaggccccaatcgtcgtacatgcgcgcatgcagaaagtactgattgatcgcgaccagttcattggcaaggattttgttgagttgctggatgactgagatgtcgcctttcatgactggggtcctgccctgtaatagctgtgtatagggcagagtctgagcggtgaaattcctagtgtcaaacctaagttattgaataataaatgaaaattaatcggaataagaatgtttgtgttccgcgtcttggcgctaactaattgaattacaggcataaaaaaaccggacactgggtccggttctttaaaacagccttttcaggcgtgtgtaaattctgtcgagtaggggagcgcggcctgggctgtttgcagctgcgtcagggtttcccgtaccacttgcttggcgaggcacgcacatttaccacactgactggcaacgccggtggtttcacgcacttctttgtagctgcagcaaccttcgtagatcgcttcgcggatttgtccgtcggtgacgccagtgcagaggcagacatacataagggagaaccgtcgcgggtttaaggcttaagtgcgatggatcttaatgttaacgagaatgattgtcaaagtagtttcgtcaacgatcagccgcgtattgcccatgcgctgacgaacggttttttcagtgtatgatggtcggtcttcacgaagcgtgattgcgtcatgtttctgtcggattctacaggcagactcgacaggtccttttgcttcaatcgtcatcccatatcaggagatatccaatgagcgtactcgtcggtaaacaagccccggatttcgacgtcccagccgtcctcggcaatggcgaaatcgttgatagcttcaaactgtccgaagccatcaaaggcaaatacggcctggtcttcttctacccgctggacttcaccttcgtctgcccttcggagctgatcgccctggaccaccgcatggacgacttcaaggcgcgcaacgtagaagtagtggctgtttccatcgactcccacttcacccacaacgcctggcgcaacactgccatcaatgatggcggcatcggcaaagtcaaatacaccatggctgccgacatgaagcatgacatcgccaaggcctacgacgttgaatccgaaggcggcgtggccttccgtggcgcgtttctgatcgacgacaagggcgtcgttcgctcgcagatcatcaacgacctgccgctgggtcgtaacatggaagagctgattcgcctggtcgacgccctgcaattccacgaagagcacggtgaagtctgccctgccaactggaaaaaaggcgacaagggcatgaacgcttcgccagaaggtgttgctgcttacctgaccgagaacgctggcaagctgtaagcgcccgtttcacggtaaaaaaaccggcctgagagggccggtttttttatgtgcggggttcaacttcaatcgctgaagtcttcccagccgcccatctgcttccagcgattgacgatgccgcagaacagctcggcagtcttctcggtatcgtagcgggccgaatgagcctcacggccgtcgaagtcgataccggccgcctgacaggctttggccaacacggtctggccatacgccagaccggcaagggtggcggtgtcgaagctcgagaacgggtgaaacggattgcgcttcatgtccagtcgcgccacggcggcattcaggaagcccaggtcgaaactgctgttgtggcccaccaggatcgcgcgtttgcagccattggccttcagcgctttgcgcacaccgcggaagatatcggtcagcgccgcttcttcgctcaccgccatgcgcagcgggtggtcgagcttgatgccggtgaactccagggctgccgcttcgatattggcgccttcgaatggctcgacgcggaagaagtgggtatgttccgggaacacaaaaccgtgttcatccatgccgatagtggtagcggcgatttccagcagggcgtcggtggcgcaattgaaaccaccggtttctacgtcgatgacaaccggcagatagccgcgaaaccgctcggccatcgggtgacgggaaccgccaccactgtgctcttgttcgtcgtcgtaatggtcttcactcacttgctttcctccagcaggcgccagcgcagtgtttcaccggcgcgcagcgggataacagtcagctcgccgaatggcaggctggcaggggcggtccagtcttcacgaaccagggtgatgcggtcggtatttgccggcaggccgtagaaacgcgggccattgaggctggcgaagccctcgagtttgtccagggcattgcgctgttcaaacgcttcggcatacagctctatagcggcgaacgccgtgtagcaaccggcgcaaccgcacgcggcttccttggcgtgctgggcatggggcgcggagtcggtgccgaggaaaaatttcgggttgccgctggtggcggcgtccagcaacgccacctggtgggtgttgcgcttgaggatcggcaggcagtagaagtgcggccgaatcccgcccaccagcatgtggttgcggttgtagagcagatgatgggcggtgatggtcgcgcccacattggccgaagcttcggtgacgaactgcacggcatcggccgtggtgatgtgttcgaacaccaccttcagggtcgggaacagctcgaccacgcgacgcatgtgctcgtcgatgaacaccttctcgcgatcaaacacgtccacgtcgccacgggtgacttccccgtggatcagcagcggcatgccgacctcggccatggcttcgatggctggcaggatcttgtcgatgctggtcacgccggaatcggagttggtggtcgcgccggccggatacagcttggcggcgtgcacgaagccgcgggccttggcttcacgaatttcgtcaggctgggtgcggtcggtcaggtagagcaccatcaacggttcgaagcagctgccggccggtcgtgcagcgaggatgcgctggcgataggcatcggcttctgcggcattgcgcaccggaggtaccaggttaggcatgatgatggcacggccaaacgtgcgcgccacatcggccacggtttggggtaacgcagcaccatcgcgaagatgaatatgccagtcgtcgggacgcagcagggtcaggcggtcggacattggggattccaggcgggtcaatctggtgggaatgctaccggaaaagactcttgcaggcactcgctatcaagttttgccggatgcgaccgatattcccgggtatgccttaacgatgtatgacgctttgaagtgttgtagaaaccagtggagccttcccgtgcgccagcattatctagccctgctcagtgtgttcgccagcctgcctgcgatggccctcacgttccagacccgcctggagaatattgagtggaaggtagaaggtgaccagttcgagtgccgcctgacccagccgatcaccgatttcggctccggcgaattcgtgcgccgcgccggtgagcaggcgacgtttcgcttgaaggcctataacggttcgttcggcgcaggttcggcgactttgttggctgctgctgcgccctggcagccgggccgaggcgatatcaacctcggcgccgtacgggtcggcagtggtgacgtattgttcaacagctcccaagcccaggccgggcgtctgttcaccggcttgctcgaggggcgtagcccgaccgtgcggcattacggacgtgagggtggttattcggaaattcgcctgctgccggtgaagttcaacaaggcctacagcgactatcagttgtgcactaccaagctgctgccaatgaattatgaccaggtcaaacagactgaagtcggcttccccggtggcggcatcgaactggacgcggctgccaagaagaagctgtcggtgattcttgcattcatgaaagccgaccccacggtcaatcacgtcgagttgaacggccattcggataacagtggcaaccgactgaccaatcgcgatgtctcgcgccggcgcgccctggcggtgatggactatttcaaggccaacggcatcgcggaatcgcagattaccctgcggtttcatggggaaagctatcctttggcgcccaacaccaatgcggccaaccgcgcccgtaaccggcgtgtgaatatccagctggagcgggtagcggcccccgagaaaccggcaccccaggccactgcgccgagcaatcctgcagccacatcataaggggcgaccatcggtcgcccgctcgacataatctgtcgctttatcttcatttgctgtcgcgcccctgtaatttcacggttttgatcggtagaatcgacgcctttccgtacaaccccgtggagtgatggcatggccgacgtaaacaaggtcgttctcgcgtattccggcggcctggacacttcggtgatcctcaagtggctgcaggatacttataactgtgaagtggtgaccttcaccgctgacctgggtcagggcgaagaggtcgaacctgcacgtgccaaggcgcaagccatgggcgtgaaagagatctacattgacgacctgcgcgaagagttcgtccgcgatttcgtcttcccgatgtttcgcgccaacactgtctacgaaggcgagtacctgctgggtacctccatcgcacgtccgctgatcgccaagcgcctgatcgaaatcgccaacgaaaccggcgccgacgccatttcccatggcgccaccggcaagggcaacgaccaggtacgtttcgaactgggtgcctacgccctcaagccaggggtaaaagtgattgccccttggcgcgaatgggacctgttgtcccgtgaaaagctgatggactacgctgaaaagcacggcattccgatcgaacgccatggcaagaagaagtcgccgtactcgatggatgccaacctgctgcacatctcttatgaaggcggtgtgctggaagacacctggaccgagcacgaagaagacatgtggaaatggaccgtctccccggagaacgctcctgacaagccgcagtacctggaactgacctaccgtaacggcgatatcgttgcgctggacggcgttgaaatgaccccggccaccgtactggcgaccttgaaccggatcggcggccagcacggtatcgggcgcctggacatcgttgagaaccgctacgtaggcatgaagtcccgtggctgctacgaaacccctggcggcaccatcatgctgcgcgcccaccgcgccatcgagtccatcaccctggaccgtgaagtggcccacctcaaagacgaactgatgcctaagtacgccagcctgatctacaccggctactggtggagccctgagcgcctgatgctgcaacagatgatcgacgcttcccaggctcacgtgaatggcgtcgtgcgcctgaagctgtacaagggcaatgtgattgtcacaggccgcaagtccgatgagtcgctgttcgattccaacattgccacgttcgaagaagacggcggggcctacaatcaggcggatgcggccgggtttatcaagttgaacgcactgcgcatgcgtattgctgccaacaagggccgctcgttgttctgactgtcaggcgcattgtgaaaatggccccttgttcaaggggccattttttttgcctcggtatcggtaggcaagcgttaaataggtgttggtgtttatttacgtttaccctgtgtaagtctttgcgcaacttgcaagggtgatttaggttgttgtcttttattttttaggatgaatgattttttacatctgctgaggaactatttctgacagaaaattcactcatgtaagtggtggaggtatgcgacatgttgaattttctgtaggaattttgagtgtgtgtaaatatgttaaatggaactaacgtaaatggaatgtgctcgccactttgcgtgcatcatcgcgagaaacaagggacatttcctgaaagtcatgtgcggcacgtttaccttttgcggcttatgccagggatatttcactcaaaatatgtatgtgtcgagaaaggtctgaaaggaagcataaagccacacacctctaagttggcgattttttgtaggttaattcctatcttcttgtggggtgggtctctgcctgctgttgctcgggggtgaatgctatgccaactagcaatcgactaggctattgtgcttgctctaaataattcgaacagcgaaattggactttctcatgaataaagtgctgatcgtggatgatcatcccgtcattcgtcttgctgtgcgcatgctaatggagcgtcatggttatgaggtcgttgccgagactgataacggtgtcgatgcattgcaacttgcacgggaacatatgccggacattgtcatactggatataggaattcccaagctcgatggcctggaagttatttgtcggctggcttcgaccaagcaggctgtatcgttcaaggtgctggtgctgacgtcacaagctcctggccatttttccatgcgctgcatgcaggcaggggcggccggctatgtgtgcaagcagcaggatctgacagaactgttgagtgccatcaaggcggtgctttccggctacagctacttcccgaaccaggcgctgaactcggtgcgctcaaccatgggcaacgccagtgaagccgatatggtcgaacgcctgtcaggacgagagatgatggtgctgcaacaattggcccgtggtaaaaccaacaaggagattgccgacggcatgtttctcagcaacaaaaccgtcagtacctacaagactcgcctgctactcaagctcaatgcccgttccctcgtggacctgatcgaactggcccagcgcaacggcctggtctagtcgggcattgcaccgctcgtacacccgtgtaaccggcagaaaaaagcctccgtcagggaggcttccggtcgttggcgcatcgatcagaaatcgaagtcgtaatcggccagctgtttttgcaagcgtcgctcttccagaagattgtcgatagtgcggcgtttgctcaaattggtcttggccacctctgcaacaggtgcctctaccccatcgtcgtccgactcaacgaggtcgtcgtccacttccagttgttctttgccagtgctcataaggttaactccaggctaagactgccattggggctccttatagcgataaaccgcgagtgggtaaaaaagattttttcaatcgactgatcaagaaacctaatggtcgctcaatcgtcagacgttttgtccttgtattcacacaggtcctcgatgcgacagctgccgcagcgtggcttacgcgcctggcaaacgtagcgcccgtgcaggatcagccagtggtgggagtcaagcagatacggcttgggcacgaacttcatcagttgtttctccacctcgaccacattcttcccgcgtgcaataccggttcgattgctgacgcggaaaatgtgcgtgtccaccgccatggtcagttgccggaatgccgtattgagtacgacgttagcggtcttacgccctacgcccggtaaggcctcaagggcttcacgcgtttgcggtacctcgcctgcgtgcagttccattagcaggcggcatgtctcgatcacgttcttggctttgctgttgtacaggccaatggtcttgatgtattcggacaagccttccacgccgagggcataaatcgctgcgggggtattcgctaccgggtacaacttggccgtcgccttgttgacgcccacgtcggtggactgagccgacaggatcaccgcaatcaataattcgaacggcgaggagtaggccagctcggttttgggttccggattgtcttcgtgaaacctgcggaaaatttccaggcgttttgcggcgttcatgggcagagcgattccttgcgggtggtctacgtcatttgaaaaaagcccaggtctaaacctggcaggtatcaacgtggtggcggccatgtcgtgtagcaaggcccccctgactcattctgggctcggtctatgggcttgcagctgacgctctgcctcgtccagccttcgctgggcggcgttcaattcatctacaggtggggccggttggcgttgtaatttgctgacatcagcgcgagcgtaggccaacgcggttttcaactggcgcagctggctgtcgatagggcgtttttccacacgctgcaaagccggtcgcggctgctcggaggctgcttcagcttcatgcaggttgtactcggcggcagtcaacgcggcactcaatgtggccagttgctggttgtcagcacgctgctcctgcgcctttttcaattccgcgcgacgcatggccagttggatcttggcccgcttgagtgctgggtccttgggaattgctgtcgctggcgggctgtccacctcaagcatggccagcacctgctccgcagcttcgaactgccgttgcaggacgatcagttgcgactgctggtcaaaagtcggtggatggccaaacgctttcaaggatttgtacaactgggcgcggctcatcgcgacggtgatcttggctttcttgatcgcagcttcctgaacaacctgatggttatctacaggtattgcgtccgtcggcgccgggcgcttggaacgtgccaggcgttcagcgagcttgtgttcttcttcccgttgcaggcgcgcattgcgttgttcataacgcctgcgtgcccgatcacgcttgaggctacgttcatggcgctcgagatcgttggtcgccaggccacccactatggggacgacactgaccagtgggcgcagctcaatgcagtcgacagggcagggggcgacgcacaggtcgcaaccggtgcactcgtcgattatcaccgtatgcatcaatttggcggcgccgacgatggcatccactgggcaagcctggatgcatttggtgcaaccgatgcattcggcttcgcggatataggcaatctgcgccggggcttcgccgcggctggtatccaggtccagcaccggtacgcgtagcaagttcgcaagcccagtgatggtttcttgcccacccggcgggcacttgttgattgcctcgcctttagcgatgccctcggcgtaaggcttgcagcccgggtgcccgcacttgccgcattgagtctgcggtagcagcgcgtcgatacgttgaatgaggttcatgctttgatcatagcgttgacgcccggccctgtgaggtgggcaagctgaaaagccccgtcgttgaaacggggcattttgcaggacttacttgatacgttgacccggcttggcgccgctgtccgggctcagcaggtagatttcttcgcctccggggccagctgccatcaccatgccttcggaaatgccaaacttcattttccgtggcttgaggttggcaatcatcatggtcaggcgaccatcgagcttggacgggtccggataagcgctcttgatcccggagaacacgttgcgctgttcgtcaccgatgtccagcgtcaggcgcagcagcttgtcggcaccttccacggcttcggccttgataatcagcgccacgcgcaggtcaacggcggcaaaggcgtcgaaatcgatttccggggaaatcgggtccttggccagttcgccattgcccccaggtgtggattgcccggtatcggtctggctggcaatcaggtcttctttcgaagcgtcggtcatggcctggactttcaccgggtcgatacgggtcatcagcggcttgaacgcgttcaactgatggttgctgagccacatggcgtggtcggcccaggtcaagggagccacattgaggaacgcctcggcgtcggcggccagcaatggcaggaccggcttgaggaagatcaccaactggcggaacaggttgatgccggtggcgcagatcgcctggacttcagcttctttgccttcctgcttgttcagcgaccagggtgctttgtcggcgatccaggcgttggcacggtcggccaggcccatgatctcgcgcatggcgcgggcaaagtcgcgggcttcataggcgtcggcaatgcttggcgcggccgccaggaaggcttcagtcagttccggcgcggcgttttccgccaccattacaccggcgttgcccttgtggataaacccggcgcaacggctggcgatgttgacgactttgccgaccaggtccgagttgaccttctgtacgaaatcttccaggttcaggtccaggtcgtcgacgccacggcccagcttggaggcgtagtaatagcgcaggtattccggcgacaggtgatccaggtaggtgcgtgccttgatgaaggtgccgcgagacttggacatcttctggccgttgaccgtcagatagccgtgcacagcgatgccggttggcttgcggtagcccgagccttcaagcatcgctggccagaacagcgcgtggaagttgacgatgtccttgccgatgaagtggtacagctcggcggtggagtccttggcccagaacgcgtcgaagtccaactccggcgtgcggtcgcacagattcttgaagctggccatgtagccgatcggcgcatccagccacacatagaagtatttgcccggctcgtccgggatctcgaaaccgaagtaaggcgcatcgcgggagatgtcccactgttgcaggccagcatccagccactcggcgatcttgttggccaccgcgtcctgcagggtgccgctgcgggtccaggtttgcagcatctgctggaaatccgggagcttgaagaagaagtgctgggaatccttgagcaccggggtggcacctgaaatggccgatttcggattcttcaggtcagtcggcgcgtaggtggcaccgcacttttcgcagttgtcgccgtactggtcttcggtgccgcatttcgggcaggtgcccttgatgaagcggtcggccaggaacattttcttgtccgggtcgaaatactgggtgatcgagcgcgtggcaatgtgcccggcgtcacgcaggcgcttgtagatctggctcgacagctcgcggttttcttcggagtgggtcgagtggaagttgtcgaagtccaccaggaactcggcaaagtcggcgctgtgttcagcctgcacgttggcgatcagttgttccggggtgatgccttccttttcggcgcgcaacatgatggccgaaccgtgggcgtcgtccgcgcagacataaatgcattgattgccgcgatgcttctggaagcgcacccacatatcggtctggatgtactcaagcatatggccaagatggatggaaccattggcatagggcagggcgctggtgacgaggatcttgcgtggctcggacatggggctcggctacttgatgaaacggaggtcggccactataaagcgccgggaaatttatttcaccccgtgaggctgtttcagaattttcggcgcctcagaaagcatgccgttcgccggccggaacggttaggatagccgcctgtttcagtcagtctttttcgggagtagcccatgagcgccgtcaatcgcgcagcggtggaagccgttcttcgccaatacaccgacccttatttgaaccaggacccggtcagtgccggttgcgtacgtgccatcgaggtccagggtgaccaggtttcggtacaactggagctgggctatgccgccggcctgttcaagagcggttgggcgcagatgttgcaaatgggcatcgagggcctggacggcgtggcttcggccaaggtcaacatccagtgtgtgatcgcgccgcacaaggctcaggcacagatcccgggcctggccaacgtcaagaacgtggtggcggtggcctccggcaagggtggcgtgggtaaatccaccaccgcggccaacctggcccttgccctggcccgggaaggtgcacgggtgggtattctcgacgccgatatctacgggccgagccagggcgtgatgttcggtatcgccgaaggcacacggccaaaggtcaaggaccagaaatggttcatgcccatcgggtcgctgggcgtggaagtgatgtccatggcctttcttaccgatgacaacacaccgatggtctggcgggggccgatggtctccggtgcgttgctgcaactggtcacccagacggcctggggcgacctcgactacctggtgatcgatatgccgccaggcactggcgacatccagctgaccctcgcgcagaaagtcccggtggcgggtgcggtgatcgttaccacgccccaggacctggcactgctggacgccaggaaaggcgtagagatgttccgcaaggtcaatattccagtgctgggcgttgttgagaacatggcggtgcacatctgttccaactgtggtcatgccgagcatctgttcggtgagggcgggggtgagaagctcgcgacacaatacggcgtcgaactgctcgcctcgttgccgctgtcgatggatatccgcgaacaggccgatggcggtaaacccactgttgcggccgaacccgatgggcaggtcgcgatgatctatcaggaactggcccgtcatgtgggcgcgcgcatcgtgttgcaggaagcggctgccccggcgatgccgaccattacggtcagtgacgactgatcgacgtggtcggggctttttttggctcgcttacaggtcaagcatgcgacttcgcgcattacccaattgggcgtgtaagcattcgcttactttctcgtaagcgtttggtttttttgctgggtgtgtacgtctcaaatgcgtgcgagttttttctatccatttgaaatataacaattatttatcttaattttggtgtgggcgcgtgtcagttcgcacgttggatcccgttgaacttctcattgaaccctctaagatcagtcctgtgtccacggattgacacagccatcaaggaacgatggtttgaaggaatgtcgcaggatgcgattcatcaggatgatgaaaaggaatacagggactagggaaaaaatgtgggcgggtcataccgccccttttttcgcctgcagaaaagtaaaagcgtccttcataaacgcaaaaaggcccgcaaggggccttttagggggcgacgacgctatcagcgttcgaggtctgcaatcttacctttcttgccatcccactccgcggcatcgggcagcggatctttcttctcagtgatattcggccagatctccgccagctcgacgttcaactgaataaactcctgcatctccgccgggacttcgtcctcggagaaaatcgcgacggccgggcattccggctcacacagggcgcagtcaatgcactcatccgggtggataaccaggaagttcgggccttcgtagaagcagtccaccggacacacttctacgcagtcggtgtacttgcacttgatgcagttgtcggtgacgacgaaggtcatttctaattttctcctcaggcggcggcagcgaaaccccttccggcggggctcgcgaggtttgggagcgatagtctgcaggccaggctaaaagcccacagcatcccaaaccgcgcgagagtctaccagcttgcaagcgtctgcgttatatccgagtcttcagtgcatataaaatttcgagcgctttacgtggtgtcaagtcatccaggtcaagcttggacaactcatccagtaccggatggggcaggctggcgaacagatcgctctggtgcggcgcggccggtttcttgctggccttggcggggctggcgaccactgtttcatggggcagggcggtggtttccaggcggctgaggtgcttgcgggcgcgggtgatcacgtcgttcggcacaccggccagctgcgccacggccaggccgtaactctggctggctggccctggcagcacatggtgcaggaacacgatgcgctcattgtgctcagtggcattgaggtgcacgttggccaccagcggttcgctttccggcaacaccgtcagttcgaagtagtgggtggcgaacagcgtgtaggcacgcagatgcgccaggcgttcggccgccgcccaggccagggataggccgtcgaaggtgctggtaccacgtcccacttcatccatcagcaccaggctacgctcggtggcgttgtgcaggatgttggcggtctcgctcatttccaccatgaaggtcgaacgcccaccggccaggtcatcactggaaccgatccgcgtgaagatgcggtccaccagggacagctcgcaactggctgccggcacaaagctgccgatatgcgccaacaacacgatcaacgcggtctggcgcatgtaggtggatttaccgcccatgttcggaccggtgatcaccagcatgcgggtatcgtcgtccagcgacagatcgttggcgacgaacggcgtggtcaacacttgttccaccactgggtggcgaccttgcacaatgcgcatgcagggctcgctgacaaaccgtgggcagttcaaatcaagattcagcgctcgttctgcgaggttgcttagtacatccagctccgccagggcggcggcggtgtcttgcaacggcgccaggcggctgatcaggtcctcgagcaaggcttcgtagagcatcttttcccgggccagggcgcggcttttggccgacagcgccttgtcttcgaactccttgagctccggggtgataaaacgctcggcgcctttgagggtctggcgacgttgatagtcgataggcgccgactcggcttgcttgctcggcagctcaataaagtaaccgtggacacggttgtaaccgaccttaaggttcgccaagccggtgcgggctttttcgcgggcttccaggtcaatcaggaactgcccggcgttttcgctcagggactgcagctcatccagctcgctgtcatagccggttttcaacacgccgccatcacggatgatcgcgggcgggttgtcgatgatggctttttccagcagtgccgcgaggtccgggtacgtgccggcagtcaccgccagctgttgcaggtgcggcgtgtccagctcggtcatcgccacttgcaactgcggcagggcgctcaaggcatcacgcaggcgcgccaggtcacggggccgtgcattgcgcaaaccgatccgtgccaggatacgttcgatatcgccgatttctttcagttgcggctgcagcttttcaaagcgatagccgtccagcaggcaggtaatagacgtctgacgcgcttgcagcacggtcaagtcccgcagcggacggttcagccaacgggtcaacaagcggctgcccatggcggtctggcaacggtcgaccaccgattgcagggtgttatcgcgcccgccggccaggttagtgtccagctccaggttgcgacggctggcgccgtcgagcaccacggtatcgtccaggcgttcatgacgcaggctgcgcaaatgcggcagggcggtgcgctgggtttccttggcatagctgagcaagcaacccgcggcgccgatggccagggtcagggtttcgcagccgaagcctttaaggtcctgcaccgaaaactgctggcacaggcttttcagcgccgaatcacgctcgaaatcccacggcgcacgacgcttggtcccacgacgcttctcggcgggcaaatccttgggccagtcatccgggatcaacaactccaccggattgatacgctcaagctccgccagcaggttctcccagcccttgatctccagcacactgaaattgccactggtgatatccagcaccgacaggccgaacagacgctcatcccccaataccgcagcgatcaggttgtcgcgacgctcatccagcagcgcctcatcactcaccgtacccggcgtaataatgcgcaccacctggcgttccaccggccctttgctggtggccgggtcaccaatttgctcacagatcaccaccgactcgcccagcttgaccagcttgaccaagtagccttccaacgagtgataaggaatcccacacatcggaatcgactgccccgccgactgcccgcgcgcggtcagggtaatgtccagcagcttggcggccttcttcgcgtcttcatagaagatctcgtagaagtcgcccatgcgatagaacatcaactgatcagggtgctggtttttcaggcgccagtactgctgcatcatcggggtgtgggaggacaggtctgaagtgtttttactcattgggtagtaggcaaattcgttgaaagtgatggggcaaagggggcgcttggcccagcattttttgcgatggcggcaaggttaacacgcgaggtcgggggttcgcaggtcgcaaacggataggtaaaaagcaaaagcggtgcggccccgacatccaccactaaaggagcggcgccgccacaggttagcggttaccagccttttctatttcgcggcttactgagtattaaccggcgaatccaacactttcaccacatcatcaaccaccgccttgaccattccctgcaagtaatgcgaagcccaggcataacgatccgtctccttggttatcgccgcatcttctgcgagttacttggacgtggagaagattggaggcgtggggcaaggcgttttgcaaggaaacaccgctgttaacgcgtgaacctgctctggcttttcataaagtcgtgtttatgaagaattgtttaagttgcgctcgtaggtcgtgccttcgcgagattcttcctggggcgagcgtttttgagcgggtgaatttaatttcgaataatcagggttttagaaaaaacatccgcactaaaacagaatcattgatgtaatttttattagcttcctatcattttttcctggctgtctattccaaaaaggtcttttgttgaaaaattcggagcatgttttattgctcacggatgtaacaaattgtttcatttttttgccgtttttcggtaccgacaagggggctttctgtcggcgaacaggtgatttccgttcgttacgacgcagtgggttaagcctgggacattgatgattttgcgtgtgtctgttcggcgcactgcaaacaagggatttgacaattatcgaggcttgaacccatgaatcatgtgatcaactccatactggaaaatgcatcaactcgcccctcaatcggtcataccaaccccgcgctactgcatgacgtcctatggcgagccctggagcacgcactcaaggccaacacggatgatgcttcccacactccgcatgcccgtgcctgtctcaggatctatgctgaaatcgatacgctgtcgtatctggacaagggtgattcgaaattggccgcagctctgggcaaggcgttcttcgaatcgcgctccagcaaagacgtcgaggcgttctggaagttgttactgatcaagcaactgctgttcgaattgtcggtcaggagtgtggcgacccagattgcttcgcaagccagtctgcctcgtcagttgctcacgctcgatccgcagttgattgcagcgcctgcgggagtaaatatcagcctgggagtgctgtgcaaagagaccgaccagctcaagcattccgttgtgctggtcttgcagaaactggcacagcacgtcgaggatcgtggcctgaaaaagcctcaagtcactgcgcagctcctgctggagttgtacaacgccgtgtggtcgggcagtaatggctccgatatcgagtcacagattttttacgccgacagtgtgtatgacgcgttgcccgacgtgcatcacgccctgggcctggcgccgcaggaaaaatggctgaccttgttcacctggttatacggcgacaaggatggccgcccctatgacaccaaccagcacaccgaaaccctggtggtggcgctggaaacggcgctgcgcaatcgctacatcgctgatatcgacagtctgatcaaggacggcggcgcacggcatcgccttgaagagattcgtgctcgcgtgggcaaggatcatcccgagcatttcaagcgtcccgccgaactgatcgacgcactgagcagcatccgttttacccagcccgccgccatcgaccgtctgctgctgcgggtgcatgcgtttggctttcactatctggatatcgagtttcgtgaaaacgccgagatgttcagcagcgtggtcgatgagattctttccagccagtggctggaaaccatcggcctgggccagggccggcactatcacgagctggatgagcgtgcgcgtcaggccgcccttgaggtcgcgctggagggcggggctgcccggacgcccgctgccctgtggcaggagtatttgcaacgcaccacgccgatttacacccggaaagccgagcaatatgccggccaggattacattgcgctgatggagcaggatccgagctatatccgcatgcacgatgcgcgcaatgcggtggaacggtttgaaatgatcgaccgttatcgcgaccggatgaaaatccacgggatcgccgagtacacctcggccctcagcgcgctggaggtgctgttcctgatgaaagcggcccaggtacgggacgggattgacatcgctttgcaacctgaagacctggcaggcgccgagcgcacgctggccacggtgcatgaggtgtacgaaaacccggtgtaccgccagcacctggcaacgcgcggcaaccgccaatacatcacgtttggccccagcgacacgggcaagcaaggcggcaaggccatgcataagctgaacatggctattggcaatcagcacaagttgatcgcggcccgctacggcatcgaggtggtcgtccacgtcatcatgggcggggaacacgcacggtgtaatggggtgatcgccgagaccttgcaggagttcggcgcgctggagggcccggaaacccgcttcatgctggccggctgtgcggagatgcgcgctcatctgctgacccgcaaccagtccgtcaactttctcagccagttgtaccgtatgcacgccgagcccaagccgcagccgtccgaggaggtcattgccggcagggttcaacgttggggggacgtggtgcgccgctaccaggcgacgttcttcgagcatccggcgctgccctccctgctgcgggacctggcgcgattcgatgtggtcagggccaccgccaaaggcacccggccgccttctcgtatcttcaacatcaaggtgttcgagtcgcgtcccgatgccattcgtgcgattccctggacccgcgctttgctggccggtggattgcacagcgaactgatcggcgtcgggcagtttgcgcaagagccggcaacttacttgtccaaggccttcaacgaggatgagagctttcacacctacgtcaaaggcatggcctacgccattgcgcgaaccgacctcaaatgcgcctggctgaccctgaccggcagcatcccggaaaagacccatatccagatgctggcgcaagccttgaagaccgaagccgtcggcaccgccgaacagctgctggccagcctgcatctggaagtgattgaaggtaagcgcttcgtgtacaaggccaccaccggcaccgagccggcagatccatggaaaatcaaggagggcagcttgctcaacctgtggcccagtctcaaggccgaggtctacctcaaggaaaagaacttgcgaatctatcgcttgtttctgatctacgccaaaagcaatcccgcgttcatccagtcgtcatcgctgaatgatttctacagcgggttcctcgcggccgtgagtaccgatgcaggcctggtcgatcccgcaagcgcccaccatttcacctggtgattaaccccgatgcccagggcaacttgggtatcggcaggcgctaccctccaagaggatcaactgtatggcagttaccaccctgatactggatgcccccgggccgccgttactgtttgaggaagtcgatcgctttcttgaactgggtctgggcgtcaccctcaacctgcattacttcgcggacaaagagcgcattcgccagcactacggcacgcgcattcactatgccgagatcaactgccatgacgagcctggctttattgccgccgtgagtcaggccgggggctacagcgtgttcaagacgcgcctgaacatcccgttgggcgctggcctgatccgcgctaccacctcgccggcgttggccacgccactgcgcgccattgcccaggctggcacaggggtcaatcatattgatcggctggcgtgcgagcagtgtggtgtggcgatcctcaatacaccgggctccaacgcggccgctgttgccgaatacgtcgtggcccaggcgctgtttctgtcgcgcgacctggatgactacaacgctgaaacgcacaacggccattgggcaaaaggctccttggcacctgcctgcgaatatgccgaactgacgcttgggctggtgggcaccggcagcattgcccggcaggtggcgcgcaaggctgcggcgctgggcatcaaggtgatcgccaccgggtccgaacgttttaccgaaccggtggcgcacagccttgggcttgaacggcgggcaggtcttgaacagttactggccgaggcgaacatcgtctcgatccacgtaccgctcaccccgcagacccgaggcttgttcggcactgccgagttccagcagatgcgccagggatcaatcctcatcaataccgcgcgcggcgggatcgtcgacgaacaccagttggccgccttcatgcgccagtttcccaggcatatcaaagccgtcgccattgatacctttgcccttgaaaaagaccgcttcgactcgccattgaccgctattgccaatgcgcaattgacgccgcacatcgctggcaataccactacggcaatccggacggcgtcacgccagatcgtcgacaagatccacgcattcagtgccgacgccaccgcgcgttaacccacaggacacaaggaaggccacattatgcaaacctctattgttacccgcctcgacgccctgagttgcaccgacctcagcgatgcgatggaccgcctgaaaatcgtttgccagtgcaccgacatcatgcctctggaccggtcgttcaaccttacaggcaaagcctggaccctgcgctacggccctattggcctggacggcggctcggtgggtgactacatcgacgaccttgaggccggccaggtggtagtgatcgacaaccaggcgcggctcgacaccaccgtgtggggcgatttgctgacctctaccgccgcccgtaagcagttggccgggacggtgattgacggtatctgccgcgatgtcgaccgtgcgttggagcttaactacccgatcttttcccgggggaactggatgcgcaccggcaaggatcgcgtgcgtgtcgaagcgatccaggcgcccgttacgctgggtggcgtgcgggtacaacccgatgattggttgcgcggcgacggtgacggcctggtggtgattccggccggctcactgagcgaagtgctggaggtggccgaagaaatccaccaggccgaagaacatattcgtgcggctatcgaggcgggcgttcctttacgcaaagctcgcgccgattacggctaccacgctttgcagactccgcgccgctgactggccgacgacagaagccgccgcgggtgcggcttcaattgatgctggccggggtggccaatatcaccgacccgattaagcgggactgggtcttgcgcaatacggacgtggcggaaatctggggtgttggccgcaagatgaaactccgccccggtgcgatttttgcagccggtcgctgctggataaggtgggcaaaaactaaaaatccgatcagtgtcttgaaaatgatgagctgatttttgcgtgctcacatctcaatgcctgatagagagaagtcaggggcatgagtacgaccagactatttggatttacgcccactagccggaaacaaccctctgatcaccccaagaaacgccgcaaacaaattgattgaagtcgccgtagtgatggcaatcaacacattgtccgagaacggcgctttacccgagtaatacgtcgaccagccattccacaccagcaaagccgcccagaaaatcaccccgcaggcagcaaaccaaaacgcacgccccgcatatttcttgcgcagttggcgttcggccttctggtcttttaggttctggcttttttcatcgtcggtgcctatggcttgctcgccaccggcttgggagtcctggtcaggccctgccacggggggtagggtgagttccaggttgtcgagttcttcactcacggatgcggctctttgggtgaatgagtgctgccatgtcttcccagtcaatagccgaaccgtcggcgcccttgagggcccaggctgtgccgtcctcgtgggaaaggttggacagttgggtgccggaccatttgccgtatttgttaatgatccggtcaatcaaacgatgggtgtaggtatcgctctcaggaaccctcggtgttacgaagacaatgtcttcggcgtcgggcttcaggttgctgagcagtgcggtcaccgggcgattaccgtaggatttcaactcatggtaaagcgacgggatgaccgggccatattgccagcgggcgaagtggtcatccatcaggggctggtcccgttcgcgcaaatgccaggactgtgtatagaacagcagcttctgcagcttcatcggggtcaggcccgaaatcttgccttccttcgcgcgttcaatgaaggcgttagcaacagctagcgctgaataagccatgagcacctccgtcgttgctggctaggtgattaaggagttttatacatagcccctgaattgtcgataagcaagggacgttgacatccgtggcgtctcaatcaggccgcccgcaagagtagtgggtaataaactgtttgcatatacagtattttgtttcatggtaaacagaattggctgtttaatgcataaatatgcaaattagcatttgccaactccgaaaactcccgtcactatccgcgttatgcaaaaacgcaacgtttctatcgtcttaagagagctgctggatcgcgaccgaatctcccccacggagcttcaccggcgcaccggcgtgcctcaatccacactgtcccggatcctcagcggcaagatcgttgatccgtcggataaacacatctcgcgcatcgccgagtattttcgcgtgagcaccgaccaactgcgcgggcgcgctgcggtgggtgggttgcgcgatgacgggcgcgacccgatgcattcggaactcaaggacataagcctgtgggacgacgacactcccgtcaatgatgacgaggtgtcgatcccctttctgcgcgaggttgaattggctgctggatcaggaagattcgtcatcgaggaaagcgagaaggccagcctgcggttcggcaagcgtagcctgcggcataacggcgtgcagttcgaccaggccaagtgcgtgacggtgcgcggcaacagcatgctgccggtactgcgtgatggcgccacggttggcgtgaacgccggcaagagcggcattggcgatatcgtcgatggtgatctgtatgccatcaaccacaacggccaactgcgggtcaaacagctctaccgcctgccttcgggaatccgcctgcgcagcttcaatcgtgatgagcatccggatgaggactacagcttccaggatatccaggatgagcagatcagcattctcgggcatgttttctggtggggcatgtacgcccgctaacctcctcgcgtaagacgaaacccgcccatgagcgggttttttttcgcccgcagaaaaccgccaaaccccaagcccgcaaggcttcaaatgcatccgtgcatttccatagcaaaaataaatgcatttgtgcattgactgtatatgcatacatgcatattcttcacctcaagccagccaacaaggcctggtggaggcggcaaggatgctgccaaggaagacaaggaaggcacgcaacatcggcaaggacgccatcgaagcgatggcagggatgccaggcaacaccggcaaggatgccgacgctctttagtttcaacgcttcaaaaacaggcagcgatgaaccggccttgacggttcagagggttggcaactgacccgggtgtgcagcgtaaagcaccagaagcagttatccggcagacagggatcgtggtcggaaaaacattgaggaaaggaccgtaccgcgccagtagcgccgaaagtccgaggacagcattactgaaaagcccgggcaaccgggctttttggaatgcctacctatcgaagcatgtgtaaatgaaatatggattattaattgctcagccaggaggcgtgacatgacaaatgaacagcaagcgttagcggaaatgcctatctggctggtcatcgtattggccgtgatcggcggagtgtctggagaaatgtggcgcgccgacaaggaaggtgcccgcggttggtcgttgatccgccgtctggcgctgcgctccggggcctgcatggtctgcggggtttcggcgctgatgctgtgctacgccgccggcatgtcgatctggaccgccggcgccattggttgcctcaccgctatggccggtgccgatgtggctatcggcctttatgaacggtgggcggccaagcgcattgggatcaaccaaggctccggccaggacccgcagtaattgttgcaaggacgctactcaaaatgacgctgatcgaaaagccatcccaactgccccaggccgtgggcgctgcgctgcatgcagccttcccggacctcaaggtcggcagccaccaggacttccagggcgacgctgaaaaaaccggtgtgcaggtcaccgtcgaaggcaatggcccgggcattcgctctcgcgaagggcgcaaggctcacgtgctgagcatttcactcagggccatggttgcccccggtgcattgccgttcgatgcctgcgacctggccagccaactcatggaccttgtgctggataaccgttgggacctgccccaggcacagtgcgatttgcccgccaatatcgtcgccgctccagctgtgcgcagcacccttgatgcggactacgacacctggacggtttccttcacccaaaccgtctatctggggccgccgttacttgaagatcctacaggccagccgctgtttgcctgcacttgggacgtctccaacatcgacgacccggcccaatacaagccactggcggagtagcccatgttcgacgcgctgttacgcatgcaattgggaccgatcgtcgaacgcctggcagagatggagacccagctcgaagacctttaccgccgcgctgaaagcttttgccggattggcatttgccagcaggtcgatgctgccagcaatacctgccaggtcagccacggtgacttgctcaccccatcgatccgctttttcaatcccagcgccggtgcgcaaaccgaaacccgcattccaacagtgggcgaacaatgtctgttgctcaactacgggggcggggagggcggtgcgcagtccgtggccctgtttggtctcaacagtgatcgttttccaccggtctccagtgttgcgacgctgacccggcgtcgccatcaagatggcacccaaagcgactatgacgatgccagtcataccttcaattgggtcaatggccccaccaccttcagcggctcccgcgaacaagtcgacgtcaaggtcggcgccaccagcctgaccctcaacggccagggcatcatcctgcaaatcggtggcaccagcctgttgctcgatgccggcggcgcgcacttcagcggcccggtggtggaccatcaaggacgactcatcagcccccgataaggacatcccatgctcggaatcgagaggaacaccggcgcagccgtcgatgactggctgcaatttgtgcagcgcgccacccgagcgctgaccacccccgtgggcactcggcaaaagcgtccgttttacggctcgctgatcccacaactgctcggccagaacctcggtgatgacctgctgatcctcgcccaaagccacgccgcccaggcgttctacaacacccacaatggcatcgacgattttgaaccccaggtcatcgtcgccacccgccaaggcgccggcctgctgctgcggtttgccggcacctggaaaaaccgccaacaaaccttcgaggtcgtgacatgagcatgttgatccccggccagaaccagctggcggaaccggccatcatcaaggtggatgagttcgaaccgttgctcgccgagttcaaggcgtttgtcatcgactacgttgccagccgagctccgcaaagcgcggccaaactcaaagtcagtctcgacaatgaaagcgaactgctgaccctggccctggaagcgttttgcgtgcgcctgcaaacccacgagcgcaaatacaacgcgcgtatcaagcagatgctcgcgtggtgggccaccggcagcaacctggatgcgcgcctggccgatatgggtctggaacgccaagtgctcgaccctggcgacccggctgctttcccgccggtaccgcccaccctggaaagcgacgacgacgctcgcctgcgttactacctggcgccccatgctccggcggccggctcgcggatgcagtatcgccgcgaagtgttcacccttggcgagcgtccggcggtgaaagtgcagagtgcgacgccgggagtggtgactgtcacctacaccttcgatccggatggttatgcggcccaggtcaaggacggcaacgctcgacgcaccgcaccgggcgaagtcatggttaccgtactttccagggagggcgacggcacaccatctgccgacttgcttgacggtgtgcgtcgacatttcgcacggccggatgtaaggccggaaaccgatcttgtcaccgtccagggcgctcagattcaaccttacaagattcgcgtggtggccaagatcaacgccggcccggactcggggctgacccaggtagcggcgcagaaactgctgcaagactacgcagagtcctgccatcgcctggaggggcgggttgaccccagctggatcgactacgccatccacagtgccggcgctgcgcaactgcaaatccttgaaccgttggcgccgattgtcagcaccgcgttccaggcgccgtattgcacaggtgtcgaggtggaggtgcgcacgctatgagtgagcctaaagcgagtttgttgccggccaacagttcaccgctggaaaaggcgttggacttgggcttcggcacgttgcttgagcgagtcacaccgccgtttccagcgctgatgaatccacttcaaaccccaagcgaattcctcccttacctggccgccgaccgcggcgtcagcgaatgggatgccgaggccagcgaggcggaaaagcgcctgaccgtggcgttgtcctggcagatccagcgccaggccggtacgcccaaggcgctgagtcatgcggtggagtcattgggttttactcccaacatcagcgcctggtatcagcagcgccccttgggtgtgccttacaccttcgacgtgcaggcgatcatcgggcgcagttggtccagcggtgatcacaaccggctgatccggcgtatcaatgcggccaagagtgagcgcgaccaggcgacgattaccatcgtgcatgagaccgaaggtcagcttgcgctcacgcaagtactcgacgcccctttaagcgacggcgagttctatctaaacggcgcgttgccggaattggcgctgattgcccggttaaacagtgccggggttgcccagcactacaccattaacgactacgagctcagggcgcagccatgacagatgaaatcacgcgcctggtgcgcttcacttccaaaggtttggatgaagtgctgcaggcaaagaaccaaggcctcaaaggcgaaatcacccatatcggcgccggcactggccgctatacccccgacggcacagaagtggccttgcgtgacgagcgccaacgggtggccatcgtcgattacgaagacctgggcgagcgccaactcaggatggccgcgctgtttgatggcgacggtgaatatgagattggcgagttcggtttttacctcgccagtgggactttgctggcggtgtattccgtggcggggaagttgctgacgtataaagcggcagcggcgcgagtgctgcagaagttcacgctggatgtttcgccgttgccggcggatagcgtgacgattgtggtggggagtgaaaacctgaacgtattgttggctgaagagatcgcgattatggcggcggcttcggttggcaatatgtcacgccaccttgacctgatgtttcgagtcatgcatatcgaagcgaagtaattgcactgacaaaagtgctggaaagattaattgacagggagttgatgatggggattgaaacgactatcacgaaagttgtggatgcatgtaataagcttacggagacggttaccaaccaaattgggaagattgatgcgcgggtagaggccgcgtcgagtcagtttactgcttggcgtaatagtgtgcaggctaaggatattaatggtcgtgcttcttatacgcaaacaattgatcttacaggactgtctaccaatattttttatccggtctggtggcgtatgccaggtaacgagagaggtatgtcggaaatcataatttccagaaactatggcttggacgcaggcctcaatccattcaacaacaatttcgagccacatgtcgccggtctaaatctgcaaatggagggctgtgggatcccatggaatggggatgctaattttttgactatcaagcgcatctctcaaacctaccgagaaaccgtccgtcgtgctcaattcgggatgtggtcgtacgtccgtccggtcactggcttgaagcccatttggctaaaccagacaccaggcacattggtctcgtccccgcaggaatctggctgctatttgcgtggcgggctgacgtatatcgtcaccaagagctttgaggaacctgtgaagtacagtcgctcagatgctgaagtggaattgagtcaagcagtgacccctgaatatgaaatttcctggaaggtgaaaccgtttgcgataaccgccaccgaacttggagaaacttatccggaaagccgattggcttacacgttggataacgacctgcgctacacagcaaaaggggtgtgaagatggttggatatatcaaaaaactactgctgccctcgggtgagacgctgatcaatgttcctgcggaccgcccaacgttgatggcattggggtttgacgaggttcgcgcagatgaactcgtcatgcaggcggaaaacagtgccaagttggaaagtgttatctctgcgcgtcgtacgttgtacgtaactgaagctgatcctttgtttctggaatggcaatacgacgacactccagaaaaagaaaaggcctggcgtgacaaagtcgccgaaatcaaggcgctctaccccttgcctgatcgcaactgatccccaccgcgaaagcggttttttttcgcctccctaaagcccctccccgcaggggctttggcattttccacccggagatttccacccatgcccacccgtcaaacctacaccgtcctcatcccattccccatcggcaacggccattggtccaccgccggcgaggaactggaactgctcgacgtcgaagcatccgccctacgcaccgctggccgccttgaactgaccagcgtcctcaattccacccccaagaaggctgaataaccatggcagaagtcctgaacttcgagcacaacggcatcactgtgaatgccactgaatcccccgaggccatgggtggcctgggtgataacgtgatcggcctggtcggcactgcgccgaatgcccacgcatcgatcccgaaaaacgcgccgttccgtatcaacagcttcaccacccaggcgttgctggaccctaccggcaccgagtcgggcaccttgttccaggctgtgtaccagatcctcaaagtggtcaaggtgccggtctatgtggtcatcgtcgaagaaggcgccaccccggctgataccgtcaacaatgtgatcggcggcaacgacccggtcaccggtcgcaagctgggcctggcggccctgagcagcgtccaggaagacctgaccatcattggcgccccaggctttaccggcaccaaggccgtcgccggtgaattcgcctccttcggcaagcgcatcaaggcgcgtgtggtgctggatggcaaggacgcttccgttgcagaccaagttgcctacagcggcgagctgggcggtgccgaccttggcttcgaccgttgcctgctggtgcacaacatgccgtcggtgtactccaaggccgcgaagaaaaacgtgttcctgtcgccatcctcgttggccatcgccgcattggccaaggtcaagcagtgggaaagcccgggcaaccaggtgaccttctccgaggatgtttcccgcgtggtcgagtacaacatcctcgacacctccaccgagggcgacttgctcaaccgccacggcgtgagctactacgcgcgcaccatcctcggcggtttctcgctgctgggtaaccgctccatcaccggcaagttcatcagctacgtcggcctggaagatgccatcagccgcaagctggtcaaggccggccagaaagccatggccaagaacctcaccaagtccttcatggaccaggaggtcaagcgcatcaacgattggctgcaaaccctggtggccgacgaaaccatccccggcggcagcgtatacctgcacccggaactgaacagcgtcgagaagtacaagaacggcacctggttcatcgttatcgactatggccgctacgcgccgaacgaacacatggtttatcaactcaacgcacgcgatgaaatcatcgagcagttcctggaggacgttctctaatgtttaccaaccgagtcagacaggccattgcggccacccttcaaggcctgccgttgtccgcaaccgtggaagagttcaccccgccgaagatcgagttcgacatggaagccatgtccggcgggcgtttcatcgccgaagaaatggccaagagcggcaaagtgctcaatgccaaactggtgctgcaaggtgccggcccggaaatcatgctggccctgggcgtgcgcacgggcgacgacattttgctgaacgtgcgtgaagccggccaggaccaggacggcaagacctacttcacctaccacaccgtcggcggcaagctcaaatccctggaggaggcgaagctgaagatgggcgacaaggccaccaccacactggaactgtcttgccgtacctacaaccgtctggaaaatggcatttcggtgatcgacatcgacgtgcgcacccagaagttcgtgctcaacggcgtcgacattcttggcgatgcgcgccgcgccgtactgatgccttaaaaatgactgcaatctaaggcaggcacggtcaatgtgggagccgggcttgcccgcgatgcaggcgactcggtgtgtctggagcaccgagttgatgctatcgcaggcaagcctgctcccacagggaccgcgttcagatctggattttcggtacttttcaatacctttcaacaaggaattgccccatggcctggatgccaccgttgcatatcctgctggctccgatcaccgccgacaccggcgcgacgatccagcaggttcagctcaaaccgttgttttacgccgcgcaaaaagacgcgctggcccgggccggtgatgacgaggacgatcagtttttcgaactggcgaaactcgccaccggcctgtcggaaaaagagctcgaccagctcaagcgcccggattacgtgagcattgcccagtacgtacatgaaatgtcgacgcgccctgcgtcgttcttcatggacgcacaggacgcgacaccccacgaccaacccgtccagttgctattgcccttggatgcagccggccgaaccctgaccgaactacccctggaaatgcccgccctacgcgccaccaaagtgatgaaaaagctcgccaccaataaagagcgcgccgagttcatcaccgcccattgcactggcctgatgattcccgacctggccggtttgaccgtgcccgactggacggaactgcaggagcgcatcgacgattttttaaatcaaccggcggacttctttcgcagcgcgacatcgacgtaatcctcgatgtggtgccgctgatctactcggtcaatgagacggagatcctcgactgggacgccggaaaagcattgcgccgctacgacattgcgatcactcgccttggcgttaaacaggagtaagcgggatgcaggacaagtattcgctcgcatatgccatggccaagaatggccgggatgcgttcggcactacagacggcgcacatgacgccgatatcgtcagccttggcgctttgtcggttggcagctcaaccccatcaacaggtctggctgacttgtccgggacagttgccgccctcactgacgcgacgctgaaactcgatgagctggctctgtcgctcggctcattgcgtgagggtgtggattctctcgacaccgccttgtcgtcgctcagggcgattgctgttcgttcgtccaacatggatgggcgaacagaatcgaagacggtggctgaatccgtttcgaccacctcagaggatttgcgccatacccgcgaggccatgacgctgggcagcgcacagataatcgatctggcaagtgcgctgcagcattcaggcagccagttgaagtttgacaaaacggcgacttcggaaaagtcgatcaaggcgctgcgcgaggagtccagcgaaagcggcaagcgtttctctacgaccctggaggccacgccggtctggggtgaagcactttggctgaaagccaaaacgggcctggtggatagtgtcaatggcgctgctgcagagtcgccggctctggcgggcgcggttaaaacggcgggcgctgttacgccggtgttttcggaatttttctccggtttgggagaaacgataaaaacccgcgttgcaggcaacgtggtcgatgcgacgctgggtaagcttccgggtgttggcaagctgttcaaggagggcggtgctgaaaaagataagtcgtgctgctgtgcaacggcaactcagcatcccatcgaaagccgccgttcgcgctcgccaggttctcgcgggaaaaagaaccctcgtcagccgaggtcgcaaaaaaagcagggatctcaacacactcagaacaggccgaagaaacaactggttgcaccgaagactgcctcgaccaaacgatcacccgcccgcaagaacggcggtgtgtttgcgcggatcctaaacagcctcgaacgtgatgcaaaggcatcgttgcctgcaccatttttaggtttcgatgccggtggtccggctcgacggttgcaacctcgtgtggccgtggcgaaccgtcgaagcaagagtggaactgcgggccagtcgccagcgagcagaggtccagggctgatcgaagccttagagcgcaagctcatccccattccttccgaaggtcgggtagcgactgcgccacaggctcgcaacttcagtcgtgaacctctgccgggccctctgaagatgcctgccaatccttcgggagcaatgagcaaactggggctggcgggtgctcgccgccttggcccgatgaagtacgccgacacggcttttgatgtgattcagggcgtacgcactggcgacgccaaggctgtcggtaccggtctcagcaccgccggtggcgcctgggccggagcgtccgccggcgccgctctcggcaccctggttttcccaggtatcggcaccgcagttggcggcgccatcggtggcttgctgggcagcgaagcgggcagttggctcggtgacaaactgttcagctcaaaggatcgcctgcccgcgcccaatgcactgagcaaggagctcaacagtgcccgcacggataacgttcaggtcacgatctcaccgagtatccagatcaccggcgtcaaccccgccgatgcccagcaagtggtcaaccaggtgatccaggcactgcagtttcaatgcatgcccatggtcaccgactctcttggcattcggcgcaacgcggcactggccgatccttcaggaggtgattgatgcgacaacaaatgatactcggcgactttatctttggcttgtcccgcggctttgcctattcgtcgttgatccgcaacagcgacggcggctggagtgacctggcgattattgccagcaagccccagtcgcggcagaacggccagaagctggaaaagctcacgttcaacggtacagccatgtacgccaccggtatgcagcgcctggacgaactgcgcgcgctgcaaaatgcgcgggcgcctttgccgttggtcgatggcatcggccgtaattggggcctgtggcggatcaattcggtggtggaaacccaaagcaacgtgatcgatgacggcaccgccatggtgatgagctggaccctggaactggaggaattcgtcaatgcgtagagtgcgaagtatcgccggtgattcggtcaacctgttgctctatcgcgagctggggcgttgcgacgacgcggcggaagaaaccctctggcgcttgaatcccgaactggctgaatacggtccgctattgccggccggcgtatgggtgatcgtgcctgagatgcaagccaggccggcggccgtgcgtcccgtgctggcgtgggattaaggaggctgcatggcacagggatttaccccgatcgtagagttctacggcgccaacgcggcgctgctcaatcaacgcctgatgcattggagccacaccgacgctggcggtatccagactgaccgcctggaattgaccctcaatatcgaagggctggaggggttgcccagcctgagtggcaagatcggcctgcgcgtcggttaccaggaaaccggcttggtggaaaaaggcgagtttgtcgtcacccaacgcaccccggtgctgtttccgatgcgcctgatgatcgtggccacggcagcgcccttcagtgaggtggataagagcggatatcgccagcgccgctccgccagccatgggccgacgacattgggggcattgtttcggcaactggtcagccgccatggtttttcaccgcgagtggcaccgacgctggacggcattgcgattgcgcacatcgaccagtccaatgaaagcgacatggccttcatcactcgcctggccaagcgctacaacgcggtcaccaagccgttcaatgaactctatgtactggccgaagcggggcaggccaagtcactctccggccagctactgccgccagtgaaattatcggtgaccggggacaaccggcccggtgagcacgccttcattaccgccaagctcgacgagaaagctcgctcaaaatacatgggcagccgcgtcagctggtgggacgccgccgccggcaaacagcgcgtggtccaggtcgggattgccccgttcaagaccttgcgccagcgctgccagaacgaagccgaagcccgcgccgtggccgaaggcgaactgcggcgggtgggccgtgaaggtttgaagctgcagatcgattgcccaggtaacccgttgctcgctgccgaaggcttgctggtgctggatgagacctggccttcgtacatgcaggggcgctggtcgattactcaagtgacccacgttggcgacccggcgacggggtatcgcagttcgatcatggccagtggattggcgtcttaggcgcgggcagaagagggagcttgagttcgtgtatcactgaaagctcgagctcaagaaggagggatgcatggttctatctgagcaacagctggttaaagtactaccaaactcccgccttaaagcgggagttttcatttcggcgttaaacacggcgatgtcccatcaccaaatcaccacacctgaacgcactgcggcattcctcgcccaaatcggccacgaatctgctcagttgctctatgtgcgagaactgggtagcgatcactacctgagcaaatacgacaccggtaccctggccgcccggctgggcaacacgcccgaggcggatggcgatggccagaaatatcggggcagggggcttatccagatcacgggacgtcgcaactacctggcctgcagccgagcgctgttcggcgatgatcgcctgctgctgcaaccgcaattgctggagcaaccgcaatgggcttgcgaatcggcagcctggttttggcagagcaacggtttgaatgaactggccgacagggaccaattcaccgctatcactcggtgtatcaacggcggtctcaatggcctggatgagcgtttgcgcttgtgggcgcgggccaaggcggtgttatgcatctcctaagtgcgttgcgtttgatcggcgtgtgtctgctcatggcgtttgtttggcaggtccaggcttggcgatatggtgcgcagcttgagctgcaatcaagcacccatgctcaagcgctgaaccagcaaaggctggcagcacaaaaccaacgccaggctctggagcaacagctcaacgtcaacgaccgccaacacatccaggagttgaacgatgcccaacgcaaccaagctgctctgcgtgaccgtctggccactgctgatgtgcggttgtcagtccttctcgacgccgctgattccgccagtggctgtacagtgccagccaccaccgcccccggcagcctggttcatgcagccccgcgagcccgacttgacccggcgcatgctcagcgaattatccgcatcaccgacgacggcgacagcgccctgatcgccttgcgtgcttgccaggcgtatgtgcaggccgtcgcgcgttagtctcttgatgcactccgtatcttgcatggtcgataagctcctgtagggtaggcgaacccctcgctcattcctggagaagaccgtgaaggaaatcactcaactggctgccgaccttggtcgtcgtttgcaggtgctcaatgctcacgtcaccactgccgagtcctgcaccggcggcgggattgccgaggccattacgcggataccgggcagttcggcctggttcgaggcgggctatgtcacctattccaaccggcagaagacgcggcagttgaacgtgccggaaaaacttttctccaaagtaggcgccgtcagccaggaagtggtggaggcaatggcccgtggcgcgcaggaaaaaagcctggcgcgatttgccgtggcggttagcggtattgccggcccggatggcggttcgccggacaagccggtcggtactgtctggctggcctttgcagtgggtgacgaggtcacggccgagcttgcgcactttcccggcaaccgcgatgacgtccgccgacaaacggtaaaggccgcgctggagggcttgttgcgacgagctgcagcagaaatagaaaaacaggggtaggcgatcccggatctttgtggaacaatactgtctacttatacaggtgttggccgtcaggccttattgattacgtgaggactttaatggacgacaacaagaagaaagccttggctgcggccctgggtcagatcgaacgtcaattcggcaagggtgccgtaatgcgtatgggcgatcacgaccgtcaggcgatcccggctatttccactggctctctgggtctggacatcgcgctcggcataggcggcctgccaaaaggccgtatcgttgagatctacggtcctgaatcttccggtaaaaccaccctgactctgtcggtgatcgcccaggcgcaaaagatgggcgccacctgcgcattcgtcgacgccgagcacgccctggaccctgagtacgccggcaagctgggcgtcaatgtcgacgacctgctggtttcccagccggacaccggcgaacaggccctggaaatcaccgacatgctggtgcgctccaacgccatcgacgtgatcgtggtcgactccgtggccgcattggtacccaaggctgaaatcgaaggcgaaatgggcgacatgcacgtgggcctgcaagcccgcctgatgtcccaggcgctgcgtaaaatcaccggtaacatcaagaacgccaactgcctggtgatcttcatcaaccagatccgtatgaagatcggcgtgatgttcggcagcccggaaaccaccaccggtggtaacgcgctgaagttctacgcttcggtccgtctggatatccgccgtactggcgcggtgaaggaaggtgatgaggttgtcggtagcgaaacccgcgtcaaggttgtgaagaacaaggtggctcctccgttccgtcaggcggagttccagatcctctacggcaagggtatctacctgaacggcgagatgatcgacctgggcgtgctgcacggtttcgttgagaaatccggtgcctggtatgcctacaacggaagcaagatcggtcagggcaaggccaactccgccaagttcctggcagacaacccggatatcgccgccacgcttgagaagcagattcgcgataagctgctgaccccagcgccggacgtgaaagctgccgccaaccgcgagccggttgacgaaatggaagaagccgacactgacatctgaagcaaacgatgactgtggtactggatacactcgtcgccgttcggcgcactgcgatggacctgctcgctcgccgcgagcatggtcgagtcgagctgacgcgtaaattgcgtcagcgcggtgcagagcctgagatgatcgaaacagcccttgaccggttgacggaagaggggctgttgtcggaagcccgttaccttgaaagctttgtgtcttaccgcgcgcgctctggttatggcccagcgcgaattcgcgaagagctgagccagcgtggcctgcaacgtgccgatatcgacctcgcgctacgtgaatgcggtatcagttggcagtcgcagttggaagacacctggcgtcgcaagtttgccggtcaccttccgatagatgccagggagcgtgcgaagcaaggtcgttttctgagttatcgtgggttttccatggacatgatcagtcgcttgttaagcggtcgagatatggacgattgaacgctacaaaacaaaaggcccactatgaaaatagtgggcctttttttttcgcctgcaataaagtcacgcgggttctggcgtcacccgttgctgcgtcttgccctgagcctgcgcccagttttccgggaggttgatgtaatccaccaactctcgtagccgcccctgatcgcggccattgaagttgaacaccaagcgggtcaaatgactgaatcgcggttcgtcgtggtcttcacctgtataggcgagttgctggaactcaccactgagccgcaggctggcaaattcttcctgcaaatgggccaaggcatggtcgctgaggggatggtgcatgcgcaccacaaactcacgcttcaaccaacgggtagagtggaagttggcgtaaaactggttgatttcgtccaccgcttcctcggcgctgtagaccaggcggatcagcttgaggtcggtgggcaggatatagcgattggcctccaactggctgcggataaagtccagggcgccttgccagaaaccaccaccaggtgcatccagcagtaccaccggcaccagcgggctcttgccggtctggatcaaggtcaacacttcaagtgcctcatccagggtaccgaaaccacccgggcacagcaccagcgcgtcggcttccttgacgaagaacagcttgcgggtaaagaagaagtggaaggacagcaggttttcggtgccatcaatggtcggattggcgtgctgttcaaacggcagggtgatgttgaaccccaggctgtgctccaggcccgcgccctcgtgggctgcggccatgataccgccgccgccaccggtgatgaccatcaggtccgaacgcgccaacgcagcgcccacttctcgggctaacgcatacagtgggctttccacaggtgtgcgtgccgagccgaatactgtcaccttgcgccgccccttgaactgttcgagtacacgaaaggcgtggtccagttcgcggatggcgcgcagggtgatcttggcgttccagcggtcgcggtcgtcctgggccatgcgcaggacggtgaggatcatgtcgcgataaagggggatatttgggctattaggggcgatcagctggatttgtgcgtcgacctgctgcgtgaggtcggtcccgttttcttcaaaatgacgaagcaactgctcattcgattcataaggcattcaacttctccttctttacagggcctgggtagtcgacgagagcgtcgtcggggccacgacactgcatgtgtcgcgacatgccgcaggagggcaggcctttcttgccctgaaagtactacagaacagcattgaaactgctgtggatgggcgtatgggatggcttgatcatgggccgaaaaacccttggctggcaaccgcttattggtcacccatcacgaagttcggttgttggcaggaaacgccgcggtggtgtacgcgctgccggacagcagcgcgtgaggattcagcagtcgttactttttcttttttgccggagccgggcagtcggcttctacgaacttgaccgatgccacaggacggttggtcttgttttcggtgatttcgtagcgcatcaccgcgcccttggccatcagctcgcgatagcccgggttggtgcacacactgcggcccagctggaagtacacagccttggggttggcgcgcatctgttcggcgcgatcaggtagcacgctgaggtgatcaatcagctgcatgccttcgacggtgtaggccacttccagggtcttttcatcgatttcccggggcaggtccttattgctttcagccgcgacgctttgcagcttcctgttcatttgagcctccagcagcgaggccgcatgggcgcccataggcaaggccaacgcaagggcgacggatggggcaacaaggcgcagcatggaacgcagcattaaactctcctgattcggttactggtgcatagaccagccactgcgctgtgcgttcagtggcgcgcaattataggtgagcccttgccactacagccaggcgtatcgctggtaaactgcgggcacttctgtttttcacgagtttgttccgtgtcgatttccttttcttcgccgcgtgcccgatgagccacgccgtttcccgcttgcgcacccaacgcctggcgcgtgccatcaggccgtttctcaatcgtggttcccgggctgagcgctgccccggctgtcgggtgattcccgaatattgcttgtgcgcctggcggcccaaagtcgcggccaagtcagccatgtgcctgctgatgcacgacgttgaaccgatgaagccgagcaatacgggctggctcattgccgatgtaatcggcgacaccacggcatttgcctggtcacgtaccgaggtagatcctgatttgctgacgttgttggctgacccgcagtggcagccatacatcgtatttcccggcgagtttgtggcgccgcaacgggtggtcagtcaagtccgcgtggaggagggcaagcgtccgctgtttatcctgctggatggcacttggagcgaagcgcgcaagatgtttcgcaaaagcccctacctggagcatttgccagtcctgagcctcgcccctgagcagttatcgcgctacaagctgcggcgttctaagcgtgatgaccatttctgtactgccgaggtggcggcgctgtgcctggagctggccgaagacttgactgccagcgaagtgctggacgcctacctcgatgtattcagcgcccattacctggcagccaagttccaaatgcccttggacccgatggacgctgtccatatgcgccttgcaccctatataccggcagcctagccagacgacgtttgcatgatggcaccctgaacccgcaacccgctagaatgcccacgggcgtagcgcttgaccctccaggctgcgctgggcatgctgggcgccgattggggcgcaaccgtgaatgctcgacgtcatttcatgtgtttttggcgttgggcgagccctgtggcgatagctgcctggctgtcgccttgtgtattggtgagccctgaacccatcaaggctcccataaaaaacaggatcatttaaccaatggccacatacgaaatcctgatagccgatgaccacccgctgtttcgcagcgcactgcatcaggcggtaaccctgggccttggtcctgatgtacgcctggtcgaagtggccagcattgccgaactcgaagcccgcctcaccgaaaaatccgactgggacctggtattgctcgacctgaatatgccgggcgcctacggtttctcgggcctggtgctgctgcgcgggcaatacccacaaattcctgtggtgatggtttcggcccaggaagaagccgacgtggtagtgcgctccaaggagtttggtgccagcggtttcattcccaagtccagcgcgatggaagatatccagaaagccgtgcgcgcggtgttggatggcgatgtgtcgtggccaccccaggcgtttgaagaaatcaatgtgtccgaggaagccaaggctgcccgtgatggcctggccagcttgactccccagcagtttcgcgtgttgaccatggtctgtgaggggctgctgaacaagcagattgcctacgagctgagcgtgtccgaggcgaccatcaaggcacacgtgacagcgattttccgcaagctgggggtgcgtacgcgaacccaggcggcactgctgttgcaacaacttgagtcaatttcgcagcattaagttacaaccgcttcacgcttttttgactttgcgtgatctagcttccccacttctttggttcagttgcctacatctatgtcgcctttcaagggtcaaaccggtatcaaacgtatcttcaatgcagggggctattccctggatggcctgcgcgcggctttcactggcgaggcggcattccgtcagttggtgttgctgaacgttatcctgatcccagtgagctttttcctgcaggtcagccgggttgagcgggcactgctgattgcggtgtgcctgttggccctgatcgtcgagctgctcaactccgcggtggaagcggctatcgaccgcatttccctggaccgccaccccttgtcgaaaaatgccaaggacatgggcagtgccgcgcaattcgtggcgctgaccatgattaccctggtgtgggccgtgatcctcgtctgagcatcaagcgatactcggcagtacgatctcgtcgctgcgctgcacccccgcggtgaaggcgcggcacagctccaggaactcgcgcatggccgaggtctggtacttctgcttatgccagatgaagtagaactgccgggccaggtccaggtccggggtttccaccggcaccaggctgccacggcggaacgcatcgcgtagcgccaggcgcgaaatgcaaccaatccccaaaccagattccactgcccgtttgatcgcctcggtgtgttccagctccaggcggatattcagcgcgctgcggtgatgacgcatggcctggtcgaaggtcaggcgcgtgcccgagccttgttcccgcaggatccaggcttcatgggtcaactcgtccatgctcgccacgccacgtttggccaagtgatgctgcggcgcacaaaacaccaccagttcgtcctccacccaggtttgcacctcgatatccgggtggctgcagtcgccttcgattagacccaggtcaatttcgtagtgcgccacctgatgcacgatatgcgcagtgttctgcacgtgcagcttcacttggctctcggggtgttgctgcataaaactaccgatcaacagcgtcgccaggtaattgcctatggtcagggtggcgccgaccgccagggaaccgaagccggacttaccgttgagcaggtcctcgatctccttggcctggtccagcaacgccacggcctggggcagcagctggtggccgagggcgttgaggctcaggcgtttaccggcgcggtcgaataattggcagctggattgacgctccagctcggtgatcgatgtgctggcggcagattgagataaggccagaaggccagcagcgcgggagacgctttcctgctgggcgacggcgacgaagacttgcagttgacggagagtaaatcgcatatcgatataaccgataacccttatcttaataatccagttaacagatattgtcgccgccattagaatgctgtgcaattgcgcatctgtatctttggcgcagacccatttccaggagtcccccgtacatgagcaacatgaaccacgagcgtgtcctcagtgttcatcactggaacgacactctgttcagcttcaagtgcacccgcgatccgggcttgcgcttcgagaacggtcagttcgtgatgatcggcctgcaacagcccaacggccgcccgctcatgcgtgcttactcgattgccagcccaaactgggaagagcatctggagttcttcagcatcaaggtgcccgatggcccgctgacttcccaattgcagcacttgaaggaaggcgacgagatcatcatcagcaaaaaaccgacaggcaccctggtgcttgacgatttgaagccgggcaagcacctgtacctgctcagcaccggtactggcctcgcgcccttcatgagcgtgatccaggacccggaaacctacgagcgtttcgaaaaagtgatcctgtgccacggcgtgcgttacgtcaacgaagtcgcctaccgcgaatttatcaccgagcacctgccgcagaacgaattcttcggcgaggccctgcgtgaaaagttgatctactaccccaccgtgacccgcgagccgttcgaaaacgaaggccgcctgaccgacctgatgcgcagcggcaagctgttcagcgacatcggcctgccgccgatcaaccccgaggatgaccgcgccatgctgtgcggcagcccgagcatgttggacgagaccagcgaagtgttgaacagcttcggcctgaaagtttcgccacggatgcgtgagccgggtgactacctgatcgagcgtgcgttcgtagagaagtgacttcgggtcacttgtaggagcgagcttgctcgcgaaggacgtcaacgataacgctggcatcttgattcaacgcggtgcctgttcgtttttcgcgagcaagctcgctcctacagttgaatgcgtttgcaaagaaaagcccgcgttgcctgtgaaggcagcgcgggctttttcgtttatgcgatttactgcgccgcaaccacttccagcacacaaatcagcccgggttccgggtagtgccagcgcacatccacatcccagaattgtgctccatactcccgttcggacgtaggcacctggtacgccggccgcggatcctgcgccagacactgctcaatcagttccaccaacggctcgccgaggcgctgagcgtggccttgcgcctgttgcagcgcagtcttgagccactgcacagcaatcagctgcggcgcgctgctggcgatgctgttggtggcgctgtcgatcatgtcggcatagggcacatacggtttgatatccagtaccggagtgccgtcgagcagatcaatcccggatatccacagccgccccggctccaccttgtccagcttcaccaccgactgcccaatgccattgggccgatgggttgcacgggtggcaaacacgcccatggacgtgttgccacccaaacgtggcgggcgcactttcaggcgcggcttgtcttccagggcctggtgaaacagaaacagcagccacacatggctgacctgctccaacccctgcaccgcctcaccctggtcgaacggcgccaccaactccagtacgccacgggcagccggtgccagttgcggttggcgcgggatggcgaacttctccttgaagcaggagcgtacgaagccgacgggcgagacctggtaactcatggcttaagcgcggacccgcagggtcaggcccttgaggaaattacgcagcaactggtcgccgcacgggcggtaattggtgtgaccgaacttgcgaaacagcgcgctcagttcaggcttggacaccgggaactcggctgccttgaggattgcatgcatgtcgtcttctttcagctcgaaggccacgcgcagctttttcaggatgatgttgttggtcaccggggtttcaatcggctgcggcggacggctttcgtccttgccgcgcttgaagatcaccaagccatcgaggaagtgggccatgacctcatccgggcagaacacgaagccttcttcctcatctttcttgaggtaggtcagcaggtcttccttggtcacctccatgccgccgagcttgatgatctcgaccatcttgttgtcgctgatgtcgagcatgtagcgcacgctgcgcagtacgtcgttgtgaatcatggtgggcaatcctggttttcaacggtggacaccgcccaatcaggcggtgtcgggaaagggcgaacgacttagaacttctctttaccggacaagtagcgccattggccaactggcaccttgccgatggacacgccgccgatgcggatacggcggatggcgatgactttcaggccaaccgcttcgcagaacagcgcaatcacaccgggttgcgggtttttcatcgcaaagcgcaggcggttttcgttctgccagctggctttgacggccggtagctctttgcctttgtaggtcaggccatggttcaggcggttgaggccgtgggcaaccatgtcgccttcgacttctaccacgtactcttgctcgatcttggcggcatcggcggtcaacttgcgcaaaatcttccagtcctgggtaaacaccaacaggccgctggccttggcttgcaggtcggcgctggcggtcaggcgcaaaaaatgccccttgagcgggcgcttactgaagcggtgttcttcggatagtgtttcagcgctgatcgaggccatggcggtttcagcatccatgccagccggtgcatgcagcaggatagtgaccggctccggagcggtggctttagcctccggatccagctcgactttctcggtcgtgaccttgaactgcggctcgtcgatcacttcgccgtccaccgagacccagccgccttcgataaacaactcagcctcccgacgggagcaaccgaccagttcgataaggcgtttggagaggcgtatggggtcagtcatgacaagggccgtaacaaaagggggcggctattgtacctgcctggcgccggttaatcccgagcccatttcatttagccctggtgcgcctgttgttgcgcctggcgcaaacgcatatgcagcagcgggtaaggctggccaaggccgtcatgctcagtgcgtccgatcacctcaaagccttgctttaagtaaaaccccagggcctgggggttttgttcgttgacgtccagttcctcggcgttcatatgttcgatcgcataggtcagtagttggcggcccagaccctggcctcggtgttgcgggtcgataaacagcatctccactttgcccgccgccacgcccgcgaacccggtgatgtgttggcatgaatccttggtgcagaccagcatcaccgcatccaggtagcgggtcagcaccaggtttttcagcaagtctatatagctgtccggcaggaagtcgtgggtggcgcgtaccgaagcttcccagatctgcgccaggcgcgcgtagtcgctggttttaggtgtatagataaccgaatgctgccgcatgcctgctgcccctcgctgtagtcggcgctgatgaacaaaacgatagacctaaaaaagccccgcatcttgtcagaaacggggctttttcaaaatattgcgcaaacccgatcagtcgcgcttttcagcccacaagtcatactcgtcggcgtcggtcacggtgcaccagaccttgtcgcccggcttcaagccgctggcatcgtcgataaacacgttgccgtcgatttccggcgcatcgaagaagcagcggccaactgcgccttgctcgtcgacttcgtcgatcagcacttcgatttccttgccgatacgcagttgcagacgcgccgagctgattgcctgctggtgcgccatgaaacgctcccaacggtcttgcttaacgtcgtccggcaccacggccaggtccagcaggttggccggagcgccttccaccggcgagtactggaagcagccaacgcggtccagctgcgcttcggtcagccagtcgagcaggtactggaaatcttcttcggtctcgccggggaagccgacgatgaaggtggaacggatgatcagttccgggcagatctcgcgccagttcttgatccgcgccagggtcttgtcttcgaaggccgggcgtttcatggccttgagcactttcgggctggcgtgctggaacgggatgtccaggtacggcaggatcttgccggcggccatcagcgggatcagctcatcaacgtgcgggtacgggtaaacgtagtgtaggcgcacccacacacccaggctgctcaaggcttcgcagagttcggtcatacgggttttcaccggcgcgccgttccagaagccggtgcggtatttcacatcgacgccgtaggcgctggtgtcctgggagatcaccagcagttccttgacgccggacttgaccaggcgttgggcctcgtcgagcacgtcaccgaccgggcggctcaccagtttgccgcgcatcgacgggatgatgcagaagctgcaactgtggttgcagccttcggaaatcttcaggtacgcgtaatggcgtggggtcagcttgatgccttggggcggcaccaggtcgatcaacgggttgtggtcctggcgtggcggcaccacgtcgtgcacggcgttgaccacctgctcgtactgctgcgggccggtcacggcgagcacgctcgggtgcacgttgcggatattgccttcttccacacccatgcagccggtcacgatgaccttgccgttttccttgatggcttcgccaatcacttccagcgactcggctttagccgagtcgatgaagccgcaggtgttgaccaccaccacgtcggcgtcctggtaagtggacacaacgtcatagccttccatgcgcagttgcgtgaggatgcgctcggagtcaaccagagccttcgggcaccctagcgatataaaccctacacgtggattattactcatatactcacagcctgcagggtctaccctggtcaaaattcgtggcgcgcgattctaagcgctgatcaaaatttgcgcaaaaacaattgtcgataacgagtatcgttctcataaaaggaaggagtgtcagggagtgtcttcaaatgaaccgtgggatccgcttgtagagaaaaactatcttgatgaacttgagtacgcccgaaaagaagcttggttgacacggaagaaggcaacggccagatcgcgtaaaatatacatgactatgttgtttgtagtgttaatactattgtttacagtgatagcgcgggtcgcacccttttcgcaaacgtttaggcaggaggttatttttagttgggagtttttaatcgcttctgcgctgtttgttatattgatagtgtatagaatatggtcgaatggttttatttatgacagtatttcatttacggagttggatgagcgaaatcgatatgaccattctcgatctgccgcaggcccgcttgcagcggccttggctggcgctttggaggcaggcaggcatgaagctgagaaggttgtaaaaacgacgactggtaacaaagtagataaggttgaacactctcgcaaagcggtatccggttttgattttgttgagcatatgcgctcaattattgaatcgctcgattaccaaattgattatgcagaagcgaaagcttctcggctattagaggtggggcgcagctttgtaagaggcggaatttctttatatatattaagtataattctgtggcaggggtatctgtattatattgggtttttgctaaatccagggattgtgattgggatggtttctactactctgatatttttaattatggagtttctgggtgcttggtatttgaagcaatataggcactacggagactcggccttctcatacatgaaggttcggtcgtcatacaataagtatatgttggcttattgcactattctcgagtttacgacggatgatcactcagcggctaaagacgatatgttgcgtgttttatctgagtcggaaaattggccagatattaaagaggttaactcgaatgattttaactacatgctccagtcggtagaggccatggggacagtctttgaaaagctgaaaggtgtatttgggcgcagtaatagtggtaatccctcttgaaaaagattggaaatgtttacagctacctccggttttcagatccgcgtcaagcgataggaagcagtgtcgatcgtcaacttgcctatgccgcttcgtgggcagcagagcgaggtatgacgctggatgccacgctaactcttaaggatgaaggtctgtcggcttatcaccagcgccatgtcaagcagggagcgttaggagttttcctgcgcgcaattgaggacggccgaatcaccaatggttcagtgcttgttgttgaaggattggatcgattgagccgagccgagccgattcaggcccaggctcagttggcgcaaattataaatgcgggtattacagtcgtaacagccagtgatggccgcgaatacaaccgggcgggtttaaaggcccagccgatggatttggtttattcgctcctggtgatgatacgggctcatgaggaatccgatacaaagagcaagcgggtgaaggccgcgattcgccggcaatgtgaaggctggatggctgggtcataccgtgggctcattcgaaacggcaaagatccgcaatggctacgtcttgcccctgaaggctgggagttgttacccgagcgcgtagcagccgtgaaacgtgcgcttgagctatacagccagggcctcggtgccggccgagccgcgaacgttatgcatgacgaaggattcaaacttacggaatggggaatctctggactgcaaatttaccgaatgatcaaacagccagcgctgcgtggcgtgaagcgtttgagcgtagatggtgaagactacgagctggaggaatattacccgagaatcttgtccgacaccgaatgggccgaattacagcacctggcaagccagcgcttccgccgccgtggtgccggggagatcccgggaatcatcaccggcgttggattagcttactgcggttactgcggtactgcagtggtggcgcaaaacatcatgaatcgccgtcgcgctgacggcactatcgctgatggtcaccggcggttgcactgtacttcttatagcaagaacggcgggtgtacttacgggggcagctgcagcgtcgtaccagttgaacgcgccgtgctcagcttttgctccgaccagatcaacctgaccaggttgatgcaggccggtgacgctggccagactcttcaaaaacaattggttgtagcccgagccgctgttacgaagatcaccacgcagctttctaaggtgaccgatgcactgctggcggatgaaagcggcgcggcccctctagccttcgtgcgcaaggcaagagagctggaagcacagcagactgcagcggaacagaaggttgctcaactggagcatgaggctatcgctacaagcggatccgttcgtccagcgcaggccgaacggtgggtggagctggcggcagaggttgaagctggggactacggcgcccgggagaaggtgcgacagctggtcatggacacgttcaatcgcatcgtaatctatatgcgtgggatgcagaccgatgggcgcaatggcccgttcattgatgtgcagctcttctcgcgttccggccagcatcgtctacttcgaatcaaccgcaagaacggtgcgtgggtagcgagcgaagactgggagtaggtcaaatgttacacctgtaacagatcggttatactgtgtttttatacagtattagcaaggagccccaatgccgagtcaaacctccgacggtgtcgtctgccagttgtacacctcgtacgagagtctgattcttcgtatccaccgccagataaacagctcgaccgctcaggacaggcggcagacggtcatcatgctccagccgggtgaaagcttggacgactgggacacgttcctggaccagctggagatggaagaaagcgtgagggtgacgcacatcgaagctggagctgctcacctaagatggaccaatcagcatttttctcgaatagcatatggctaatttctatcgcataaaaattagtctgcggcttgattaaaaataagccgtaggctaatttgtcttcgtcagctcgtggcagctatttgcgctgcctgatcgtaacggagacctacagcatgacccttcacctaacgccctctgtgagggcacggctttgtcagcagatcacccaaaacggtgtgttctctcatagcatcttcgattacagcggcgtgatctgcgcgaccgctgtcgtagcgattgagcagtatgagcgtgccgtgttgatgcgcgttgaaattggtgacagcaacaacaccgtcacactggcggtcagtgaggacactggaacgcgcgccatcaggtttctggaagatctgatcaacggcgtgagcgtcagtaccgtgcggggagttgatgagattctgtttgtcactgatctggagctggttctgcgcgaggcactgcggcagcagcagggcacatatgagttgccagtagatcaggttgagaatctctggttgatgctccgaccgagcgcagccgatccatcgcggacagtctttcacttcgaattagatagcgtgggaattaccttgccgtttcgcttgcccagtgaccgtggccatgcctacgaattgctgtctgcttgcgtgcaagagttcgttgctacctatcgcagggaccggtaagacatgcttgaagacaatgtagtacaggctctggcgatcagtatttctgaactggataaacgattgcttgttaatggtctcgtcggttggagggccgccaacggtgacatcgatgaggccatcagcgctgaaaattggggggcgatagaccgcgctcaaaacgaccgggcatcgcacgcaaataccattgcgcttatcttccacaaatacactgacatcacgacagagcaaggggcgcacgcatgattggtattccaacgacaggcgcccttgaacatggccgcatcagtgccaatgtcaccaacggttatcagttcaaaaccgcggatggccggccggcgcgccttgcaatcattgacgaccaggggaacgtggtggagtcaggcgacagcgtggccagggaggcgtggaacgtatgcatcgctgtggtcaagaatttcaaaatcgggcagggacatatcgttgttcacagtgcccctccaggtatcacgccatcgaatgcacaggcagcgccggcaaaaaaggctgtaggaagacgataagtcccgatgctggccggggcgaagacgtgcgctacatgccggtgattttggcgtcgattgcccgcccgataatttcccaactgtcatccagcactacgggctggtaattgggattcagcggcaccaggtagcccacgcctgcatcaagaacgtattgcttgaacgtggtttcgccgctgacaaggttgcgtgcaacgtagaacttgctactgatgacatcaaatccttccggacacaccaggataggtgttccttcggggaaggtgggcggtgtatccgacgtcatcgacttgcccttgacgcgtaaccagtagcctttagggccagcgttttccgtggagctcagccattcatctgagattccggttggatagcagcctgacgactcaatcccacgtccagcatcaacccaacttaccaacggatattccgatgcctgcctatgaggctggatcattgggctaacgttcgccatctcagcaatttccgcagccaaacgcgggctgaaactcgcaataggttcctggagcaatttcgccagtactgcagcaaagcgagcattcagcgggttcgtacccttcagatactggttgacggaaactggcgtaatcccagccgcatcagcgatctttttttgcgtgagtttaagggcgttctttttggcgagaaaaagatcgtgagcggctttgcactcagccagaagggcctcggacaatggtttttttgagttcgtcataagcagattataagccgcaggctaatattattccgttagccgttggcttcctatttaaggattttaatgaatccggcggctaattaaatcttgttatttaaatagccgtcggctaatattccgcgctcatagacacctgaggtgtatgtcgtggaaaaaatctcgttgagtgacttcgtcaagaaggttggccaggcaaaggttgcacgggctttaggcgtcaaacctgcatcaatcgccaaagcgctgaaaatgcaccggaatattgaggtggcggttgccgctgatggcgcctgcgtggctcaagaggtgcgtccattcccctcacaggttgcggatgaccaagacggcaagcaggctaagagcagcgacgctgcatgaccacgtccagtccacgacagttgtccgtttcccgagaccaggtgctggtggctcacgccgtcgagatgattgctcgcacctgtttaagccaagacgacttcgcccaggtgttgagtgcgaatttgcaccagcagatccctgcgaaggccgcgcttaaggatgttcccgacttcaccgcgctcgccctgggcaacgacaccacgtcgttcctgcgagcctctggcgcctggctgcgccgcgttgggcgctggctcaatggcgaagtagatctaccgagttggctggaagagtcttgggttgagacgctggccggcgactttaaggacagctgcatcaacgagttggccagtcggcacggtcttacaggggcgcgtgaattggatgggaacggcaacccgctaggggcgttcggccaattggttacgcgcctcggcaccaccgttgctttgggcagtgaaatactggctgacggtcgtatagatgctgacgacttggataagctgccagagtttgttgatcgcctgcgctcggtggaagcccgatgcggcgagctgcggtcgcgagcggaagctgttctgcttgagcagtccaagcacccccacctgtcccgggtgaactagtgcctgtgactaccctggacaaggacatccaatcgcgtgcggccaacagccgtaagggtggcaccagtaagggccggccggcgactgttcataaagacaagaaaagtccgcatgccgcgctgcacgccccaattcgggcacctcggtattcagctccacgtcgcttgacggggcagcagctgaaaaacccattgttgcggatggcgttctctcggctccggcagatcggagacctacgcggtaaatacttacgggacctggacaccatccatggcggtcgccgtacgcgctccgaaaagtttgaagccctggccaaggcttccgagcagatgcttttgcggttggacttggctaccggtgtattggggtggctcgacgtcgagcgcgggcagtacttcctcaatacgcaatgcggcatcgcggaagattgcgatatgtccccagcgtctctcaaccggctgatgcacagtttggacctggcggggtacgtctaccggcggatcgaaaaagttcggctggacgaaaaggacgaggctgggcttaacctggtgcggactcgtgttctggtccggttcaccgaaaaattcttcgcggatcttggtgtgcgctacctttggtttcgggccaagaaggctgcgatcaaacgccgggacaaggagctacgtgaagtcagcggccttcgtgcggcacgccaagagaaagcatcactggaggcgttccggcgacagcaatcccgcaacaactgggagagaagtgaggtgcgtaaggcggctcatgcgcatggccaacacgaaacgctgaaccctactaccggatcacctgctgggttaaaacctcccctggagcctgacagagggccgggcggtgtgggtgagtccatggcgcgcctactgcgcaacgtccaagtcaagaaagacactccgacgaattaatcgcatcccctgcgaggccgggttacgcctggtggtcgaaaaaacaccctcccgttgtacttgtttcacctgcacgcgtcgtaatgcggttaaacgcgtaccgtctccctccatttttagcgtctttttccaacggcgccggcgtgcgcgtgggtgatccaggaagcctttgaattaaacggaattttatacccctctcagcatccccaaagggtattaaaaagagattttcgaggtgtccgtaggttcagtgtgttgggtacatgatgatgccttcgcccaagggctcagttcgctacgctcagctttttatgaggagcgcgggctgcgcgcccgcccagcggcagggcagtgccctgcacccatgctagatacccatcactccgtgctggcgatctagcgccctcaaagcggtaattgggcgcgccgaggtgagttttaaaattcaccggcagcggtcgcgggcgtgttcgggcggcgcggctgatatttttgggtgtggttttgacgggctcccggccgctacgcgggtagcgccgcaccaccattgtgggattcactcgagaatgtcgcggcggcttatatgcctgcgctgcaggcattccgatgcgatagccgccattggtgttgggcagtgccacatggcggcactgtatcgatgaggagtgggcgaggcggggagtaggggaggctggtccggcagtcaggcgggttgcgaggcgccgacctggagaaacagctcctgctgctgttccgccggcaaattgcggatacgttcgaacaaaagcgtttccaggcgttgtgtgggtggccgtagtgagtgcttgaaagtcagctcggatacccacgtgtgcccgcactgagcatccaggcattggcaatacagtttcacatacccccgggtaatctcttcccgtgagctgattcggcccttgtgatcgcaggcagtgcagtagattcgcatagttccctccccagggtttaagagccatcattatgcctttctggttggtgataatcactaactactgtctatttattcagttgtttgcttgggtgtttcgagttttttccagttgattctcctgtcattgcgaagagtgtcgttcacttggttgaacagctgacaaatcggtctgatttcgttgctggtgtacacacgatcgatcttctcaatgtccccaaacccgccgctgttttccgggatgattccggccagggcagggttcatacgccacgccgcgatcacgtcattgcgcgtgatgttcttcaccttctccagttcgtccttggcctggaagtcccccacggggatgatctggatggcgttttccttgccgttggggatattgacgaacatcgagcggaagttacctacacccttgctggcgctgatttgggcgcgcaggttctcttcgtcttcttcggtcaggtccgggtcgttggtgtagaagatgtaacccgcgtgagcgccgttgctgtagtagcgccggcggaacagagtcgcggcttcgttgagcaacagcgcctgcagaccgcccaggtagtcaggcacgccgtagatgttctgttccacgtcgtagtccaggacgtgttcgatttcatcctggtgaaagtccatgtacttgctgtctggcagcagcatcctgaaaccgccgtcgaccttcacccgcatgttgatggcgggcaggtgctgcatctccagtacttcgccaaaggcattggtatcgcgatagaagtacgcttcgccaaacaccatgtaatccaggctcgcccggcccatggtctgcgtgctgcagccctcagatgggatgaattcacgcaaaagcaggttgcgcttgaacttcggaattgcgccgtggtgtgcgttggcgcgcagcagcttggccaggcccgcccgtgataccggcggcttgtagatttcgccgtcgtcgctgagaaatacccccaggtactcgcctatgttgccggacagtacctgttcgggttccccgaaggtgaacgcccgcatgggctgtggctgtcgtacctgctggctgacttggggctttttgtgtcgtggcttgggcattggttccgctcgtgacatagcggctacggcgccgcttgttggtgttgaggggttcattgaacagcgcgtgcatgatcgaccaggcgatatcggcgtgaccggtggcgtccgtgcgcgaagcgctgtaggtgacctggccgctggtggtggtgccgcgcttgatggtcaggaatgcctgagcgatatcggtccagccggcgtcccactcgatgcgactgccctggatcgtgtcctgggccttgagtaccagagtatttttggtttcaaggctgtaatggatagcggtcgcacgcgggtagaagtcgcgcaccaggtcaaacacgccgtaaccgataccggtcgtgtcgatgccgatgtgctgcacgttgaaacgttcggtaagtttcttgacctggtcggcctggtatttgaatgactgcccacgccagctgtgtttttccaggatgcgaaatttcgccccgggttccagtggcggggcgatcaccacgcaggtggcgtcgtcgcgggtccggcttggatcgtagccaagccaaacagggctgttaccaaacggccgatccaagtccgggttgtagtcctcccacaacgacaggtcggaatagcatcgctccagatccttgaggccgaacgcgctctggctgctgtcgatgaacttgcagtagaacagctgctggaatttgtcttcgtcgtattccagctgcagctgttccaggtcgaacagatcgcagccgccggcgatagcgtcgtccagggtaatggtcttgcgccattggccatccgggcacagcgcgccctgggtgtaagacgcctcggtgggccaagtgccgccggctttcttgccgcgtttgctgttgcggaattcctcaccagaccagaacgggtacgcctggtgcgacaccgcgctcggtgtcgaaaagtaggttttacgccatttcttgtgggtgcccatggcgctggccacggtgctgagtttgtcgaagtcacgtatccagaaatactcatcgacgtagacgtggccatggtagccctgggcggtgctgctgttggtgctgagaaagcgcaactcggcgccgttgctgagcgtgatcgggttgccggtcagctcgatgtcgaaccattgcttggcaaactggatgatgtagctgcggaaaatctccgactgcgagcggctggccgacaggaacacctggttgtcgccagtcagcaccgcatccatgaacgcttcgccggcgaagtagtaggtcaggcccacctggcggcttttcaggatgttgcggattcggcacgtcagcgggttttgcttggccgcgaacagctcctgctgatagcggtacatcttgctgatgaacttatccaggaagtcgacttcggtcagcccgctgatgtcgttcttgtcttttttctcgcgtttcttccctccgctatcgccacggcccgaacgttcgccacgcgcgccctggcggcgctcctgcggttcgctggttgattcccccgccggtgccggcgacggtttgaccgcttgctttaacaagcgctcgcgtaccgttgtcagtcggtccagctcgttgagttcgtctttggtcaggctgctggctttgtccaggagcagggtgattcgccggccgacggcggtcagcggctcttcgtccgacagcatgtcctcccacccgccctggcgtatccagtagtagacgatgcggatattgggcaggttgagctgcgcctggatttccttggccttacagcggcgcagaaacaggcgtttagcggcttctttaacttcggtcgagtagtacatgggccgcagtctatgcggcgaaaacgctggaaacgcggggttaaattccgtgatccacctatatcgtggatataggagaaacgcgcatttgaaccgtttgtttggggcttggcggctccctatcgtggcggctcattcaaccgattgagcgcagttatcgcccatgccccgttcccttgtttcgttctggaaacgtgtcgccaccagcggcattaccgccgatggtcgcgagatccttccccaggagctgcgcgatatcgctgaaacctacaaaccgtcgaaatacacggctgtgatctggtgtgaacaccagcgtgcagaaggctctttcggcaccgtttacgcggtccgtctggtcgaggagggcgatgatctggaggaagggcaagtcgccctggaggcccagctcaagcccaacgatcgactgctgtacctgaatgaccaggggcagaagctgtttaccagtattgagatttggccaaattttgcaggtagcggcaaatcctacctgaccggccttgcggtcaccgacacaccttcgagccttggcactcaagaactgtacttctcccgccaaaccaacaaatccacgtactacgccgcgtccgttgaactgggctcttttgaagctgagccgcaaagcgaggtcggcaagctgatcggcttgctctccggtttgttcaagcgcttttcaacggatgccgagcccgccgaacccaccaccccaactgagagcaaacccccaatggatgaagctaccgcaacggcgcttaaagccctgctggagcagctgcttgtcgtcgctgccggcattcaggctgtgattgaacctgccgccgcagatgcaccagaacccgaccaggcacccatcgacgacgtgagcgcggccgtagacgagatcgtcactacagcagaagacgagcgtgagttcagccgtaagggcgcggccacgaataaggcactgttggcgagcatggcggctttggaaaagcgcttcaccgccctacagaacacttccgcaggtcgccagttgccacgcaaccccggtccagtagccgccccacgacgtaaggtgctctgacatggcccagcctttaagcgcccgtggcgccaagcaatatgctgagctgcaggaagcgatcgccgaagcgtatggcgtccaaagttcggcccgcatgttcagcgtcgacccgacgattgcccaggagctgaacgacgcaatcaccgcgaaagccgacttcttggaacgtatcaacgtcgtcccggtgagtgagatcaagggcgaaaaagtctttatcggtgtgaatggcccggtcactggccgcaccaataccaagaccaccgaccgcgaagccaaggacgcctcggcgctggacaataccacctacgaactggctgatacccagtcggacgtgggcctgccatacgccaagatcgacgcctgggcgaagtttcccgacttcaaagagcgctattccgctgcagtgcaaaaacgcattgcccaggaccgtatcgttatcggcttccacggcacccgtgccgctcctcagaccgatctggcggccaatccaaagctgcaggacgtgaacaagggctggctgcagcaactgcgcgagcaagccccgcagcaggtgcttaaagagggcgccaccgccggcaaggtgacgttgggcgctggtggtgactacgccaaccttgatgccctggtacatgacaccaagcagatggtggacgagatcctgcgcgaagatggcgacctggtcgcgatcatcggcaccgacttgctcgcctctgacaaggccaagctgtacaccaagcaaggcgacacgccgaccgaaaaagagcgcatcgaaaacgcccaggtgattgcgacttatggcggcctgccggctttcagcgtgccgaacttcccggtcaacgcggtgctggtcaccagttgggacaacctgtcgatctactaccaggacaccagctggcgtaagcagacgatcgagaacccgaaacgctcccgcgtcgaggactacaacagccgcaacgaaggctacgtgatcgagcagctggaaaagatcgcgttcactgagaacgttgaattggtggcggcgtgagtttggccatggcgcacaagcgccgcaccctggccatgggcagcactgcagtagcggcgatgtccgctgctgcaagcttggcctatacgccggccgatgcactgagcagtcccgccaatgcgcgcaagcacctgctgctgcaggaagcagcattggaccaggatctggagcgcctgagcgcgatgaaaggggctttggcgggacgccaattgctcaagcgcgacgagctgctgcccaagtaccaggaatacgtccaacgctactgcgagtcggggctgaacttccctaaccgcgttgcggtgcaggtgatggtgtggctgttcgacaccgcccagttcgaagacgcgctggagctggctgacttcctgatggagcaaggccagaagatgccggagcgattcaagcgccgcgacatccagacctttgttgctgatgcggtagccgactgggcctatgacgaatacaactcgggccgcagccctgagccttacctatccgagctgttgccccgcgttgacggcgaatgggacctgcctgagcagatcccgagcaactaccacaagctgatcggcatgcgcgctatggaggctgagcagtgggcaaccgcgctcaagcatttggagcgctccaccgagctgtacgcgaaagccggcaacgacacccgcatcaagaaggttcgcagggccttggaaaaacaagcggccgctaacccggccaccgagtaaccgactaccccccccagcggggacctgtggaagtgagccgcccatttatggaccgtcccactgaaaacaggctccccgccctatttgagcggccagcaatgagcttttccgggaaacccaccacctttgtggaactgacgatcgagaatgacggcttctggccggacctttccgtgaccgagtttcagaaagaacagcgcgtgccggcggagtacctggtagagctgctggtcgacacactgaaaagcgccatgttcgaagtgaacaccgacctggcccgcgtgaaagcgaagctgcaggcggcaggggtatcgaacctgcaggcagcggccggtatggccaccccggcagaatgggcttacgcctataaggtcacgctctataaacgcgctgtctacagccgtgccaagggcaattcactgccccagtttgccaccgtcacccgtcgcgaaagcgctgaaaacacgggcaaggaagcgccggagcgtgctgaaaccttcctggctttcagccagcaggccgtgcgtgcgctacaaggccgcggccgcattacggcgtcgttgcaatgatccagctgcaggcgctaaccgcctacctgatggcccgtaacctggtggcgcctgagctattcgacagctggacggagcaggtcagccttgagctgatctggaagcccgaccgcgacggcttgcacatggctgacatgcgctaccgcgctgtgttctcgctggagagcttcactggcaatccttccaggctgatggccctggtcggtagttggctggaaacccacgacagcaaccgcgaccgccacgagctgccggccccgatgtttaccgttgaaccacttgaccaggacagcttcgacgtggagctgtcgcttgaattcattgagccgcagtacctggccgaagatcctaccggcgagatcgaggcgttcggcaaaacctgggcgttcgtgcccttcgatctgtgggtagctgagcaaggcgaggtgggcagcgatggccgctaatccgctcgccctcgatgtcaggggcttgctcaatgtcgacgcccagttggcgttgcttgaactaccgccccaactgcgccggcgattgctgaacagagtgactacacgcgcacggacgatgagccgtaagcgggtgcgagagcagaagaacaccgacggcaccccattcgctgagcgcaagggcagtgccaaaggcaaaaagaagatggaagccggcctggccaagctgctgcaggtgacccgcgtgagttcggacgaagctgaactgggctggaaaaacgccctgacccgctgggtcgccgcgcagcagcacaacggcgtcagcgagcgacgtaccgccgcgcagatgcggcgctggaacaaagtccccccaggcatcgcctgcaccgacaaacaggccaagcgcttgcgccggctgggcttccgtgtccgccagaaggccaaaaaggcattggccaggccatcagtggcttggattcaagagcatgtgaactacgccaaggccggcctgctgatccgcattttgaacgacgaacgaaccgaaacaacgggcgcgcaaagctgggacatcaccctgccaaaacgccagttcctcggtgtggagagcgggagcgaaacccgcgacctggttaaccaggtgttccaacaaatccttaattcaccccgctaacgaggcacaccatggcacttggcaaggtcagcgttaacaatctcaatctgggccaaggcgccgtgactgagatcgagcgctattttctgttcatcggtcccggcccgaaaaacatcggcaaattgatcgccctcaacaccgacagcgacctggattcgcagctgggcttacaagccagcgacctgaaaacccagattactgctgcccgcttgaatggcggcgatcgctgggcttgcctggcggcgccgatcagcgctgacggtgactggaaaatcgccctggaaaccgcgcagcaacagggcttttccgtcgaagccgtggtggtcaccaagccagtatccaagggcgacgaactgtcggccatgcatgacgcggctatttccctgaacaacacctacggccggcgcgtattcgtcatggcagcgtctgccggcatcgtcgcacctctgacctggtcgcagtacctgatagagcaaaagccgatcaccgccgacgtggccgcgccgcgtgtgctggtggttccgcagctccacggtaatgacctgggcgtgttggccggtcgcctggccaatgccgccgtcagcatcgctgacagccccatgcgtgtggccagcggtcccgtgctgggcctggggccagtcccggtcgacgccgaaggcatcccgctgccatctgcgattcgtgccgagctggataaggcgcgcttctcggtcgcccagacctatcccgactacccgggcgtgtactggggtgacggcaacatgctggatacgcctggcagcgattacctggtgatcgaatacctgcgcctggctgacaaggccgctcgccagatccgccccctgttgatccgccgcgtggccgatcgccgcttgaacagcaccgccaacagcatggccgtgaacgtcaacgcgctgatggcaccactgcgcaagatggccaagtcgaccaagttcgccggccaggtgttcccgggcgagattcaaacgcccaaagacggcgacatcgtactgacctggacgagcaaaaccgccgttgaggtgtacatcaagctcaagccccacaactgcccgaaagacctcacggcaaacatcgccctggacctttccaccgacgattcggagtaaccccccatgtcacgtattggcggcaagaactttgacgtgaacctgggcgatctgcaggtccacgtcgagagctgcaccctggatatcaccgacaacagcaagaccgcgcaaacccggggcgtgcctgacggctacgtcgatggcgatgtgtcagctgctggcgagcttgagttggactcggccaacttcggtttgctgatcgacgcggcacgtgctgccggcagttttcgcaagctgggggcgttcgactcggtgtttttcgccaaggccggcgacgacgaactgcgcgttgaggcattcggttgcaagttgaaggtgtcgagcctgttgaacatcgaccccaagggtggagagaagaccaagcacaaggtgcctttcgaggtcaccagcccggactttatccgtatcaacggcgtgccgtacctggattccaccgagatcgagggcattagctgatggtctgcccgttcgatcgcgcccaagccctggaacaacgtcagcgggaccaggctatcaacgcccagttggcccaggcccggcgtgagtcaacgggcccaagccttactcactgccaggactgtgacaacgagattcccgcagcgcgccaggcgcttggcggcaagacccgttgcgtcccgtgtcagtcatttttcgaaagaggagtgcagcgatgagcgcgaatcaggtggcccaggacaccgccatcgcattggcaaaggcgtcgcctgcgatcggcgtagcggccactggagcgacagggaccgtcgactggtcggctgtcgcctacatgctgactgccgtttacatggtgctgcagatcctcctgttggttcccaagtatcgccagatgttgcgcgactggaaggtgaagccatgagcctgcgcggcaagatcgccgccggcgctatcgcactctgcagctccacgctggtggtgttcctgggcacttgggaaggcaacggccagaacactgtctacgccgacaagctggcccgtggcctgcccaccgtgtgcaaaggcattaccggccatacaagcccgtaccccttggtcgtgggtgactactggtcggacgcccggtgcaacgaggtggagcagctggtgatcagcaaaggccaactgcagctggccgactgcatcaccaaccaggacgtgggccagaacaccttcgacgccctgagcagccatggccataacttcggcaaccccagcacctgcgccagtcgcgccgtgagcctgatcaatgccggccgcatcaaagagggctgtcaggcactggcctgggcgcctgatggcaaaaccccggtgtgggccttcgtcaccaacgcccagggcaaaaaggtgtttgtcccgggcctgcacgcgcgtcgattggcggaagcggctctgtgcgaggcgggtttgtgatgctgcgcgatgccttgtttcccgtgctgatctgcctggtggcctggttgtgtatcgacttgctggaaggccagcgcgacacagcccgtagtgagcgtgacgccgcgctcttcgaagccagcggcctgcgtgaggcggcgcgtatcagcggcgagatgctggccgagcgtgacgccatcgactttcaacgtacccaggaactgaaccatgaacgtgctgaaaacgatgctctgcgccttgacgttgctgctggtcgtaagcggttgcgcgtcaccgccacctgcagggcctcaatgtccaccagtgccggcgccagcggcgtggctcatgcagccaccgccgaactcacagcagacgctcgaccggattatttcaccctcgtcgaccagctcgccttgagcaagaaaatgattttgggcctgcaagaccacgccctgcgggtatgcccgcgccaaacacaaccgacactcaacccctgaacggagcaacacgatgaccgatacacgcgatatcaccctggaagtcggcgacaaggaattcaccttcgcactgaccccgcaggacgtgaccaagtacttcaacgccgtgacccagaccaacaaggtttcgccggccaacaacctgctggtgaccaccgtcaagcaggaagagcgagccagtctcaaggcccagttgggcaacccggtactggtcatgcaactggccggcgcgctcctcgaggagtacggcccggacgttgaaatcaccgtaaaaaagccctcgaccacgccgaacgactgaccgaaaacggccttggccaactggtagccctggccagccgctggctacctggggtcgagcccaccgccgaggtgatgggcacggccaaatggctggaggacgaacattggcggcggatggaaattgccatcgccaacggtatcgcccacgcacttaacggataaacatcgatgacagaccgtagcgcccgcctggccttcattttgagcctgaccgataaggtcacagcccccatgggcaaggtgaagacgagcttttctgacctggcccaacagggccagaagaacatcacccagatgggccttggcctggctgggatggtgggcgccggtgtggccatcacccagtccctggaaccggctctggagatgaaccgcgccctgggcgaagtccgatcgctgggtgtggccgaagatgcgttgaatgcactgaatcgcaagtccctggaattctccgtcgcctatggggagaacgcccgggattttgtcgcttcggcttatcacattgaaggcgctataaaagggttggtgggcaatcaactggcgacgttcactaacgccagtgacgtgctggccaaggctaccaaggccgacgcgggcaccatgggtacctatgtcggcaccatgtacaacctgttcaagggtcaggccgacgccatgggcaaaggccagtgggttgaaacgctggccggccaaactgccaccgccgtgcaactattccgcactagtggcgagcagatcggcgaagcattcaaggcggcgggcggcctggccagcactgccggtgtgagcttggccgaacaaatggccgtgttgggcacgttgggcggaaccatggacggcggggaggctggtggcctctacaagtcgttttttgagaacgtcagcagcgcatcggaaaagctcggcatgtcctttgtcgaccagcagggcaagttgctgccgatgatgaacatcctggacaaactcaaaggcaagtttggggatctgtcgatcgaggccaacggcaagcaactgcgcgacgcctttggtggtgaagcggcccgcctgatcaccaccctgatgggcgacaccggccgcttaaaaaacggcatggaacagttgggcaatgttcgcggcctggagaacgccgagcgcatggccaaggcgatggtggacccgtggcaacagttcggcgccgctgtgcaggccctgcgtgttgccttcggccagtcattgatcccgatcctggcgccgctgatggatcgcctggtggggatcgccagcacgctgactcggtggacccagctgttccccaacattacccgcgtgatcggtatcgccacgttggtggtgttcggcatcatcgccgcgatgtccttgcttactttgaccgtgggcatgtcgaagatggtctggttgggcctagtcacggtgtggaaagtgctgactatggccggcctgcgcagtatcgctatgttcctgtaccacaccgttatggtgatcggcttcgtggccggcctggtgctgatggtcgcctggatgggcctggttaagggcgccatgctgctgtggcaaggcgctatctggttggtcaacaccgcgttgctggccaacccggtgacctgggttgtgatcggcattgttgcccttgtcgcggccgtggcggcggcgatcatttactgggaccagtggaccagcgcgctactcaacagcgaggcgttcaaatgggtcagcggccaactgaccgccttgtctgactggttcgattcgatgggcggctggtcgagcatggccagcgccgcctgggacggcatcgtcagcatctttaaacaggccatcaacggcttgatcgagatgttgaacaagatccccggcgtaaacattgaggcagcgtttggtgatatgccggcggcgcctgaactgccgggtatcagcgcgccaaccatcgaggctccgttgctgccgcaactggtgagcgctccccaggagtcgatccaggcaccgctgatgatggccaacacgccgaaaatgccggcgtcagccatgacggccttaaacagcctgcagccccgggcccaagcgccggccctggtcatggccccggtaccgaaaaccccggcgccgatcgcgcagccactcgctgccctggagccaccacgtcaaccgccggccctggtgctggcctcggctcctacagagaaggccgaacagagccagcagcgcatcaacggcgccgtggccagcctttcaccgaaacggcccgacgccgtgccccggggcggcttgctggcgagcatccagaacaacaaccagacccaaaacaaaggcacccacgtggagaacgtgaacattcataccggtaagcaaatgaacccgctggagctggaaggcatgttggccatggcggtgggcggatgagcgagtacatcgacctgttgatcgtcgacaacgatctggcgctggacccatcccgccagcctctgctgatcgaggaccgggccagcatcgcccaggacatcgcgcacatgatccgcgagagcggcttgctggtaacgctcgtagccgagcgcagcaagttgcgtcagcgcgactgcatccagcagttggagctgctggtggaggccgacgcacgcttggtaccgggtaccgctttgattaaccaggtgcagtccgggcagtacctggtcacggccgaaaccctgaagttcggtgacatcgaggtgaccctgtgagcgacgtcgattttaaacaggcgctggcagacgccggcattccggtcaccgaggaagggctacgccaagcctgggaaaaggaagtcgctgcccagggcagcaagatgagcaacaccagtgcctattcgccgttctggcgcgtgatcacggcgctggtgactaagccggttatgtggctgatcagctttatcagtggcaccgtgctgcccaatttctttgtcaaaactgcccgcgccaagtggctggacatgctggcctgggcggtcaacgtcgagcgcaagggcgcgaccaaggccaagggcgtgttgctgtttacccgcgacgttgccggcggtgcgttggagctgcccgccggcatcctggtgcagtctgccgcgatcaacggccacatctatcaactggtgaccacccaggcggtcacttttgcggacgggctggtgcagctggaagtccctgtagaagcgcaggacgtgggcagcggctacaacctggccccgggttattacgcgattctgccggtacccattgccggcattgtccaggtggtgaacgccgatggctggctgattgcaccaggtgcagatcctgaaccggacgatcagctgcgtttgcgcgtacgtaaccagttctcggcggtcaaccagtggcacaccgatgcggtctaccgggcgatgatttcagccttcccgggcgtgcggccggatggcgtgtacttcctgcacggcgcgccccggggcccaggcagtgccaatgcctacgtgctgtttgaagcggacgtgccagcggcgacgtacctggagcaaatcaacgcgcacattcgcgatcagggcaaccatggccacggcgacgatctgctggtgatggtcatgccagagacccagcacgcgctgcgcctgactctgtggccccgcgctctattgggcgccgaacagcgtaccaagctgcaggccgacgtcgatcagttcatccgcgccgccttccgcgagagcggcaccggtgactatcagccgacgctgacctatccgcagtcgcggttctcattcagccgcctgggcgaagaactccaccagcagttcgccggcattgagtcgctgcactttgataacgcggacatcgtgtcggaactgagcatcccgcggattcaatcgctgcaggtggtgttcgcatgatcaagctgaatttgccgttctggctggatggcccgcagctgaccaagctcaaagccgccagccaaaagtggtgggagacggtcgagggttggctgcagtggcctttgctgcagatggatgcggacacctgccacctgaccgtcctggatctgctggcctggcagcgcgatatcagccgcttcaaggacgagcccgaaagcctgtaccgcctgcgggtcaagttcgcctttatcaacgccgtcgacgccggcagcacagcgggcctcaagcgcatcctgcagcgcctgggcgtgggctacgtcgagatcgacgagcgtatgcccgatcgggactgggacgtggtgctgctgcgcctttccgactcgcagctctcgcaaaaccctgagctgatgcgggttctgattcagcagtacggccgcacgtgccggcgttatgacttcgtgaccatcacccccgtatcactgcgcattgtcgcggtggacttcaacgacgaccagcaaacgctggttgccagcctgtaggagcctcccgtgggagccagtattacccttgcaggtgaaagcctgatcgcgcaaaaacaaggcgcacaacaacccctgattgtttcccgtttcgtcctggccaacgtgcccgggctggatcctaacggcccgatcgaccgggcggcgccgaagccggccgcgcacctggtggcgacctatgacgtcacccaaaaaggtttcgtgaaccccaaccagattgtttacagcctgatgatgggcagcgatatcggggactttgactggaactggatcggcctggagagcgccgagaacgtcctgctggccgtggcctacgtgccgctgcagcagaagcgcaagaacattcccccgcaacagctgggcaacaacgtcacccgcaacttcctggtggttttcgacggggcccaggcgctgactggcatcaccatcgacgccaagacctggcagcatgactttacggtgcgcctgcacggcattgacgagcgcgagcgcttgagcaaccgcgataccttcgggcgggcctgctttttcagtgacggcctgaaactgtcgaaggtcggcaacggctaccaggtgcagccgggtaccgcctatgtcgaaggcgtgcgggtgctttcgactactgctgttgctgtcgcgccgccggcgttccccgccaaagcctggctggatgtgagcctggagcgccagttaagtgatgtggtggcccgctgggaggtgcgtttcggcgccgccctggctgacttcaccgacagtgccggtgtgcgccatttctgcgtgccgctggcggatctgcctgactccaacgccgtgatcgatctgcgccaggctgagccgatcagtgattccctggtgaagcatttcgcggggaaaaagtgggtcgaagatgagctgaaaaagaaggccgacaagggcactacccttggcagctacggcatcaccgacgccatcccgaacctgaacatattgccgggctacaacctggatgtgcacgcgggccaatacggttttctttccgcaacggatgaaactcacctgtgccagaactgctactggaacggctccagttggttgcgccatgacatcactaaacccgctgtggcgctaattgccgggggcggtagtgtgcgtatccagcgcgtgcgcgcaggcgctaatccaatcgtttgggagcgcggcgactatgtgagggatagcggtgacacctacagttcgtcggacgttgaccaactgatcaagacgatcaatacggccatcagcaagaaggcagacaaaggaaagacgctggctgagtacggcatccatgacgccattcccaatctgaacccactgcctaatggcagcttcgatattcacggcggctcctacgcatttctgacttcgatcagtgaatcgaacgtcagtcagaattgctatttcaacggttcgcagtgggtgcgccatgacgagtcaatgccgtcagcgacggtgtttgtcaactcaggcggcgcttatgtgcgtaaggcggaaccagggcctaaccctattcagtggtcgtacagcgctcaactgatggacagtggcaatacctatgacgcgaagtcgatcgaccgctttttcttgggggtgaatcagtcactggtgcagcaggataaggccattacgcagatcaactctgacctccgcaataaggctaacaagggtcgaaccctcgctgagtatgggatcggtgatgctattcagaacatcaacccgctgcccgaggcgagcctggatctgcacggtgggtcgtatgcttttgtaacggctgaacgggaatcgcacctggcgcagaactgctactggaacggctcaagttgggttcgccacgacacgagtaagcccgctgtggcgttgattgctggggctggtgggttgcgggttcagcgagttgccccaggaccgaatcctattatcttcacgggttcgtccgaggtgatcgactccagtaagaaggccgcacctggtacggcgggtattgctccgattgccaccttagaacaggtggcagcgggcgccgatgaaaccagcatcgtgacgcctcgcaccttgcgctggggattcgccatcagcttggccgccaatggctacatcgccttcccccgctggttgggcgggctgatcgttcagtggggtaacgcttacatatccgctaacggcacccagtttctattcccgatcgcgttcccgaacgagtgctttgttctcaacatggggtcgggggaagacacctccaacagacaagcagaagtgatgaatatcactgtgggatcacgcaccaggacaggctttataggcaacgccaccgaggcatcgacatacggctatatcgcgatcggatactaaggaaatcccatatgagcaaatatttttacagcccatcgctgcacaccttcctggtcgagggcatacacccgaaacgaccaggtgattgcgtggtagtcagctatcaggattattcctatctgctggccaagcagtcccagggctttcagatcgtattcgacgtagaggccaaacagcccctggcgcgtctggcccctggcaccagtaagcccgagcaattaaaggccctctatcagcagaagagcggcgagatcaacgcagcgtgtgaggccgcgatcattggtggcttctggtcggacgcgctcggttcgccgcaccagtaccccagcaagctggacgatcagttgaacctcaccggcgtgatcctgcagggctttgacagcccatacggctgcagagacgcggacggtgtgaaagaactgcgaccgcacacggccaagcaattgcgccaggttagcgaagacttcaccacctataagatggagctgctgcagcgcgccaaccagttgaagcagctgctcgatcaggcgctggcagacggcgatttaaacgcgcttgaggtggtgacctgggagagcctgcagtcatgacctgggcaccggtgacgatgcgctggccagaccaagccacccaatggatgggccaactgtcagcggccaaggatctggccagcactgagcaggccagtaccgccaagcgcttggccgatctggacggcaaggccagcaccaacccggggccggtgggtgatgccgcccagggcgcgatcgttgcaggccgtggcgccttggctgagcagatgggcgaggccccggcgtgcctggtggtgacgccgtttcaaagtggtatcggtcagggtcgcggctatcagcgctttttgtcggctccgaacctactgcagcagctggccggcaagctggtggacgtgagcgacaccggccggccggatggtccccagttcgccctgtgcctgatgttcctggctacgcgctttgatcaactggccgagagcctggcccgcttcaatgcgctattgcccatacctgacctggtgcgagccgaacgccgcgcacggcacctgtcgaagctggagacggaaaagtgggagattcccgccgccggcacattgccgcgctggcaggcgttgcccctggagcgctgcactgtggtcaaggctgcgcagcaatccatgtctggccagctcgctttcctggagagctacgcggccgacagctcgcccatggccgaccttgccgcattggccaaccgcaaggcggctcaacagcaaggccgggatcagcagctggccgaccttaaagcctcgctcgctggcggcaaccctgacagcagtatgcgcgcgcgcctgatcggaccaggcaacgccaccgagctgcgccaggcgttgctggccggtgatgccccggggcatgaatgggtgctgtgtgccggcgcgctcctggtgggatcggaaaaaggtctgagctttgttcgtgagttggtgggcctatgacgctgctactggatgggcaagaggtgcgcgggaagaacctcaaggtcaccggcaatctgcgcattgagagcgacgacttgtcagggcagaccagcaacaccgacaaagggcacaagggcttcaagcccaagaccctgaccgtcagcctgatgattcccttcgttgaccaggtgcaactgcgcgacctgatgcgcctggtggaggcgaccgaaggcggtggccagctcaagacctaccgcatcgtcaacgacaccgccgccgcgttcggcatgcgccaggtgacgttcaccgaaggcgtgagcgcccgggaagacgacaacctgcgcggctggctgatccagttcaccctaactgaaaagctgtcgaatcctgagaaagtcgagggccggcgatcgggtaacgcggtcaccgcgcaatctggcccgggcggggcagtgggtggcagcgggggcaccggtggcgactccagcagcgggccggaggaactgaccggctttgaagccacgctgaaaaaggtggacggctggctgggcggggctaacacatgaagctgcacaaggagttggccatcaacggcgtgccctacgtcctggtcaaaaatgaagttcggctggacgcgaaaagccccggccgggcggcgtttaccattcaagcctcggcgccggtcaaggggctggtgacgctcgatatcggctacaacggcaacacgctgcagcgacactttattggctatgtcgaacgctccaccacggccagcagcacccagcaggtgctgttctgccgcgagctggccgcgatcctggccaaccctttgccgctgaacctgcgccacgtcgacctgcgcgccgtcctggtcgagatcagtaagcacaccggattgcgctttcgcgtcccggatcggccttacgccggcgttaaggcgccgttcttctacagcctggccgctggctaccaagccatggacagcctggcccgcgttttcaacatccccgactttatctggcagcagcagggtgacggggaggtgttcgtgggcagttgggccgacagcttctttggtgttcgcccgccgctgcaactgccggtggaactgttcgatgactaccagggcaatcaaagcgcgatgattgcagcccttcccgggttgcgaccaggtgcaacaatcaaccacggggagcgcatcaccagtgtggcgctcatcgacaaccagatggccatccgatggacgacgcaatccgccgcagcgtagaacgacaatttcctgaactcaccggtggttaccacttgccacgctttgcccgcgttgtcgccgtggccgacgccccggccggcgccggcatctgcgatgacttcaggccgcgctatgcggtcgacatcgaggtcatgggcccggatggtgagccagatcccaagctgccgatcctggccggcgtaccgctgccgctgccaaccggtggcgaggaaatgggcatctatgcctttcccgaggaaggtacccaggttgtggtgtgctttgcctatggcctgccgcacaagccctatatccaaaccatcctgccccacgggctgagtatgcccagcgtgccaaagggggaccaggtgtggcagcacagcgaagcctgccaacagcgtgtggacgccgatggcaactggctgcgccagactgacggcatgatccgagacaaagcgatcgagcgggaagtagaggctatgggcaacacggaaacgttccagagccacaccaggacggtggacgaccactcaactgagtctgtgggagggatcaagacgatcgaggcgctgggcgcgctcaagctgctgtcgggcggatctgcgagcttggcggcggtagatgatctgcaccaggcgaccgggcgagacttgaacctggtggtggggcagaagcacaacgccatggtaggtggcgacatggaggaaagaattcagggtttgcgtaagagtgtcgcggcggtcagtcaacggctggttgcgcccaagacgtggctggggtccgaaagggtgaacgtgctgcaggtgctatgtaatttgcttgacttggtacagcagatgaacaacgagttggctagacacactcatggacccactccaatcccaacgaacgctacagagttttcaaatagcgctaggaccgccctggagcttggagttacgctaggaaaagttacactttgatttgatattttgccttggtaagttgtagtttggtttgttggtaacatattgagtctgagtgtaaggttttcaggggcgtagtatggattgaggcggtattaatatttttgttttgtcgagtcgagctacctttagctttataaagctgcctttgcggaaggcagctgcagattagtggcttgtatttagtaagtctttgcgataattaccaggcttgatttttgcttagctcaattctttcgagctcgacttgttcctttaatagatccagttctttggataggtttgcatgatctttagtagaggagtattcaataaaatttatttttagagagtcgctcagaacggatttaacttcagggcagaagttgttcgatgccgttacaaagtagtggctctgtccataaggatgtctgtatctgtaattttctaataaagatcttatatctggatcgctcacgccgcatcctacgaatatgaaagtatgggtgcgaaggagtgcatccaatagttcataaaactgactgtgagagttacgggccttagcgtaatcggtcctcgtaaaaatcaatttattcggtgaggaaatcgtcccgtgactttttattaaaacccgctcatgtcggcgtaaacaatctgctatatcatcgtcatgatatatttttgtggttagcgctccagccccccgctcacctgctgcagtttcgtaaatgctatcgaagttcggtgtgatggcaattcttaggtctaaattaaaaagtgttttgtgtattggggctgctttgaaatccggagtatggaagcgagctttcacaaggtttgtgaatttttcctgtcttatttcatttcgaattacctcggccgcagtcagatagtcccctgccttaataagtgcaagaatttcttttacagtcttcttttttctcggcgcgtctatttggcttgcggcctctgtcaaaaaacccgcccaactgggaggtctgacgccatcaatccctgttgaattcatagagacgcctgcaccaaaaaaaagcacgcagcgtctgcacgcaatggaatgaattaactccttaggccagattgacatttaacttatctcgttcatgtttatactaaggctgccagcaatgtcggagatgactttttcgaattgttttactttgtcaaagtgtgcgcctacaactccatccgcagacttcaacatgaatattggtttcgtagaagtttgggccataggtaccaggctactgaagtaagggatttcgccgagtttgtactctaggtttttgccaagatttattttttctattaagctttttttgatggcaggtccaatacgtttgattattttctcataagcatcaacaggctgtttttttcccgcaacggttttagcagtgtattgctgagtgacatagccaaggaactttattccctgaggatttcgctggtgcaagccatcaaaaaggaaatcttcgttgttgtcttctttgtagcttgtaagtccgcgctctaatcctttagtccagctggtgatcgcgacttcgatattttgaagtccacgcaaactgaagatgtccgacgacataggtaaaataaaatagtcacatgacaaaagtactgtccgattaatcgctcccagagaagggccaatatcaaagaaaacataatcgtatttttttttggatgcccattctagaagcgctctaaaaagaaaagttgtttttaatcctcgctcttgaccactggttgcatctacccaatcttttgcgagaaaatcctcagccaaagaaaatcttggatcaccgggaaccacatctacgccgaatgactcacttctttttatcggaatatcagagtagcctttagatttttttagcgaggtaactagctgatttattgtttcaccatcttttgatgaggagtaaaggtcgtcaagtattttttccttaaacatatatgccgtagcgttgcattgtggatctgcgtcgactactaatacttttttgttgcctctcaaagcatagtgtgcagctaagttgcaaagaagagtcgtcttacctacgccgcccttgttgttgaaaacgcaaaaagctttcatgttatatcctttggtaaaaatcaggcacagccttaattatgttcgtagcagttgacggactttttctatccattttttatcatggataactcgtgagtgttcgtgctcgccatttataatttcttctttggatagccctgaaagctcttcccagttttccccgaatacatatgtggcgttgttcagatatatactttctaagaaatgaagttttttgtctgtaaaaccatatacaaagtatcctgaataaccgcctcgacccgtcgctaaaaagtcaggttcgtatttggagatctcgcgcattctgtgctcaatcactcctttttcagaatgactaagttttgttaggtagggtgctagtacacctgatgctttgttccaggggtattttcctcgtggcaatacttcccattgaagctggcgagtaggcacgttcgagattttatggttagatatatcaaatatctcaaactcgaaaaaatattcgaatagtagattggctaaatgaataactggtgcttgatcaccattcaaatctattgtgcgcgtggatatatacatcacgtcgtcaatttttttagtgacagcttctccgcaggaggagtgatgaaatctacagggtagacgtccatcgtacgatgctgaataccgtcatgctcctttccgtgccaatccttccatgtacgatactgaggtatcgattttttgattaatggaagatcctttctcttaacttcctttccgctaacattaaaacttgaaatttttccaatgctagaggcaagaattgaatctccatcagctttaaggaagtcaataccaatttcttgttgtcgggctggcggtatacggtcttggcgaactacgaacatcacattgttcgcacctttagcctcagctatcaggcgcgccatactcttgattgtcggtcccttaatcattgctgctcccattgactgattttgctgaatgtcgaaggtagcatcttgatatcgcgcttggaaccctgtcgaggaagtcggaatgtaagccgacgtcagcaggggggggcgcctgctcgagatcctttattgggcggcccaactcctatcatggttctgaagacttgcgttcctttgaccgggaaaaatcgattggggaaaaaatcacatcagaaaaagcacttatccccctcccgccgacgggctctgcgtcccttttttgtgcaaagcgaggtggcggtgtaaaccatgcccccgcctaagcccgctgcgggctctgtggggcagttggtgattgcatagagtgaaaggtattgcagagaaatgtcatgcgcttgcatcgcgtggcacgacgtccatcggtgatggtgagattctaaatgccccggccggcctggtcgtgcgccagcaaaataagccgaaacctctattttcattttgagcgcagctcaaaaaacatgagttctgcgctctgtctaaagcgggagggtaaagagctaaaagccgctgctggcggcggctgcgtcagtttcacttgagtgtggggttttcatttattgttcggcttggagatttaggtgcggtaggttggctcggttcaccagtcgacgatgttccgcgttcacatgtgaatgcagcagggttttaagcaattcacctagctgctttgcggtcccttcatctagttttttcactgtgcctacgcgagcggaggggctgcaaatggtgccggcagatgcattcagggcatcaaggagaccgctcacgtagccgtctaggaattccgctttgtcgaacagaactcgactttcaggcgcttcttgataatcccaatctacccgccagtatttaccctccttcatgatgtcgattttgggtagggaggggagtgctgttgggcttttcatcttgggctccaatttttagataatcgaccataaaaaatgccccaacagtccgttagggcattttttgtagagtacctgctacgcaattaagcgcaggcctcttcctctgcgcgatgcgatacgaccttagacatgcccactcccagtgcctgaagtactttcaaaatggttgagagttttgggtcgccgccaaccgctagcgatctgtaaaggttagctctgttaaggccagtgttctgcgacaaattgagtaacccgccacgagcttctgcaacacgacggatagcgacaaggaatgagtcctcaccaccatcttcgtcgatttcttcaagcgcgacagatagatactcgagggcaaatgcttcgtcgtctcggagcatttgaagaacgctatcttcgtgagatcgagtacgaatagtcatttttgcttcaccttgtgagatttccagagagccttggcctgatcgatatcgttctgctgcctgtcctttgagccaccacccaataggaaaacaatttttcggtcctggattgcgtaatacacgcgaaaccctggtccgaaatccagcttcatctcaaagaccccatcaccaaccggctctgtaactccaaagtggccaagggacgctcggtccactctggtggttattcttgcttttgaacgcttgtcttgcacggtgtctagccaagcttggtagatgtccactccattggcagacagtacgtgtttcacttcgtacataagaaatgtaccttaaaagagacaaggtgatgattgaatttctatatcgatcccaaagggaaaggtgaaaacctcaccgaagacaatcccaaagcaaggctggaaacgtcgctgaatacacgtgtggaatggcacgttgatagcgtggtgagtttaacgcttgagcagacgattgaggacttaatgaaaggcagaacaccctgaaaaatcaaggtatagatagagaatcattagggcaacccagggaaacaaagccaaccttggggttggcttttgcgatggtggtggacatgtctaacctcggtattgaatgacgctgccggtcgtgcacgacaaggcagcggaagggcgcttggtgcgcctctgatcaaaaagtgcgcaattctagcgacgggcaacgaacttgaccagctttatgcagggaaatgcgacgagtgctgcgctatgcttcgcgccgttgcgcatgggcaaagcccttgggtcaataaaacgtctgttacgagaagtaaaacagcgcatgctagggtcagcttagacgtgctgtttataaaagacctcgggtcaaagggcaggagtggttgatgggtcaggcaagtagtcaggcaacaggtgccgagcattcaaacgccaagccgattggcatgctggtggcagcggtcggggtggtttatggcgatatcgggaccagcccgctctacacccttaaagaggtgttcaacggcggttatggcgtgcaggtcaaccatgacggcgtcttggggattctggcactgatcttttggtcgctgatctgggtggtgtcgatcaagtacatgctgttcgtgctgcgcgccgacaaccagggcgaaggcggcatcatggcgctcaccgcactggcgcggcgagcggccggggagcgtgcaaaactgcgcagtttcctggtggtgtgcggcctgtgtggcgcggcgctcttttatggcgacagcatgatcaccccggcgatttccgtgttgtcggccatcgaaggcctggagctggcgttcgatggcctggaaaaatgggtggtgcccatcgcattgattgtgctggtggcgctgttcctgattcagaagcacggcaccgatcgcatcggcaaactgttcggcccggtgatggtcacctggttcctggtgctgggagggctgggtgtgtacggcattctgcagcagcctgaagtactgaatgcgctgaaccctgcatggggcgtgcgcttctttatggtgcaccccggtatcggcgtggcgattctcggcgcggtagtgctggccttgaccggtgccgaagcgctgtatgccgacatgggccacttcggccgcaaacccattgcccgtgcctggttcatcttggtgctgccggcgctggtactcaactatttcggccagggcgccatgctgctgggcgatccggaagccgcacgcaacccgttctacctgctggcgccgagctgggcgctgatcccgctggtgggcttgtccacactggctacggtgattgcatcccaggcggtgatctctggtgcgttctcattgacccgccaggcgatccagcttggttacatcccgcgtatgcatatccagcacacctccagcgccgagcagggccagatctacatcggcgccgtgaactggtcgctgatggtgggggtgatcctgctggtgttgggcttcgagtcctccggcgccctggcttcggcctacggcgtagcggtgacgggcaccatgctgatgaccacgatcctggtgtcggcggtcatgctgctgctgtggaaatggccaccggtgctggctgtgccggtattgctttgctgcctgttggtggacggcctgttcttcgcggccaatgtgcccaaggtgatccagggtggcgcctttccggtgttggcggggatcgtcttgtttgtgttgatgaccacctggaagcgcggcaagcaattgctggtcgagcgcctcgacgaaggcggtttgccgttgccgatttttatcaacagcatccgcgtgcagccgccccatcgcgtgcaggggactgcggtattcctcaccgcacgcccggatgcggtgccccatgcgctgttgcacaacctgctgcataaccaggtgttgcacgagcaggtggtgttgctgacggtggtctacgaagacattccaagggtgcccgccgcacggcggttcgaggtggattcctacggcgaaggcttcttccgcgtgatcctgcacttcggttttaccgacgagccggatgtgcccgaagcactgaagctgtgccatctggatgagctggatttcagcccgatgcgcaccacctatttcctcagccgcgaaacggttatcgcctcgcgtatcaagggcatggcccgctggcgcgaagccctgttcgccttcatgttgaagaacgccaacggcaacctgcgcttcttcaagttgccggtaaaccgcgtgatcgagctgggcacccaggtcgaaatgtaaggcgctgcactacgggagccggcaatcggctcccgctttcctttctgaaccctgtgctatcgatagttgtcgactaggctggtaggagcgagcttgctcgcgaaaaacgtcaacgataacgcgttaatgctggataaacgcagcgcctaagaggccttcgcgagcaagctcgctcctacagaaatgtctagaaacccagaagaggtgcgccatgagtcagctgctcgaaccctataccctgcgccaattgaccctgctcaaccgcatcgcggtctcgccgatgtgccaatactcaagcgacgatggcctggccaacgactggcacctggtgcatctcggcagccgcgccgtggggggcgccgggctgattttcaccgaagccaccgccgtgacggccgacgggcgcatcaccgcccaggacctgggcctgtggaatgacgcccagatcgaaccgctgcagcgcatcacgcgctttatcgcggcccagggggcggtagcgggtattcagctggcccatgccggacgcaaggccagtacccatcggccctggatcggcaagcatgggagtgtcaagccgggggagggcggctgggtgccggtgggcccatcaccgattgccttcgacccgaatcacacccagcccaagccactggacgaagcgcagatccagcaagtaatcgccgattttgtcgctgccgccaagcgcgccttgaccgcaggctttgaagtcgtggagatccatgctgcccatggatacctgctgcaccaatttctctcgccgatcagcaaccagcggcaggaccactacggtgggtcgttcgaaaaccgcattcgcctggtgcttgaggtaacccaagccgtgcgcgccgcatggcctcaggagttaccgctgtttgtgcgggtgtcggccaccgattgggtagaagacggctggaacccggatgaaaccgtggagctggcgcgccgcctgaaagacctgggcgtcgacctgatcgacgtgtcgtccgggggcaccgccgccaatgccgagatccccaccggccccggctaccagacgcgcttcgccgagcgggtacgcaaggagtcgggcatcgccaccggcacggtcggcatgatcaccgaaccggcccaggccgagcacatcctgcgcacttgccaggctgacattatcttcctggcccgtgaattgttgcgcgacccgtactggccgctacatgccgacgatgacctgggtgggcgcaaggccatctggccggcgcaataccagcgggcgacccatcgcgaccagccgatccatgagtcggacctgcgcgactgatcttgcacacggccctgccagacccaccctgacacggtgggttttttcttgcccgcgtttgaaggaaggctgatccttggtggtcgtgaagcaggagacccctatgctggtggaacgcgcattaaccgaaaacgatatccccttgctggcaaccatcgaccgtacggaactgatccaggcgtgctatcgcatggatcgcggcgaactggtgttatatgccgcgcaccatgatatgcgcggctggcccgaaggcgaggccgagcaggatgcagtggctctgcgggcctgcctccagcgtggcggatggttgtggggcgtatttgacggccaggcgctggtcgccgcagcggtgttggataatcggactttccatcatcaaggcctgctgatgcggcagttgaagttcctgcatgtcagtcacgcggcccgtggctcaggcctgggcagtcgattgttggtgctggcctgcgagcacggccggcaagtgggagctcaagcgctgtatatctcggccacgtcgtcgcgtaacaccgtggacttttacctgcgccatggttgccgactgttgcagcaacctcatgctgagctgtatgcacaggaaccgttagacattcacctgtatcgaccactgtgtgagtaacggctgtagggttttattacccagggtatttttttaagttaatactctaaaaaaatcccacgtgcgacgagatagtttctaagattagggtaagtctggttcctggcccagggaggcaggttgcttgtccacgaaagcgttgcgcttcggggagttggtaagtgggcaccaggagtatttgactgatatcaggagtaacagtccatggccaagtcctatggcgtagcgggtgcggtggcgtctttcctcagccgccggatgtccttgcgggatcgcaggttgagttcggatgaaatggagctgctggcccagtatcgggcgctgaccgaaagcgatcaggtggcgatgcggtacttgattggtgcgatgaaaagcgtatcgcgcttctgagctatatacgatcactcccacgttctcgcgtgggaatgatcgcgaagctcacctcaggtgtacttgcgctgctccggcgcaggcgggaagtactggtagagccaggtttcgctcaaggttcggtcctgtgtgcgaataaacaggcgcagctccaccggctccacgctgtcgctggtggggtaccagtcgaacaggatgcgatagcccttgatattttccagcaccagcacgctgaaatcctttacctcaccatgggagcaggtcaccaccggttcgatgccggtgcccgccggcaggcgatccaggccgccgcccttgaagtcgacggcgaaacgccgtgcccacacctgcgggtaatgctcgccgggcgcccagccctcggtaaatccacccatgcccgaacgagtcgcgtcgacctgtgccagcggcgtgctcaccggcggcaatgcgctccagtacagcttgtagccataattgagcgaatcaccggcggccacgggatttttcggggtccagaaggccacgatgttgtccagggtttcgccggtggtggggatttccagcaggtcgatcgagccttcgccccacgcagtggtaggttctacccataggctggggcgcttgctgtaccagtcgacggtgtcctggtagctggcgaattcatgatcggtctgcaccaggccgaagcctttggggtcggtgtcggcgaacgcattgaattgcagcttggccgggttgttcagcgggcggcagatccactcgccattgccgcgccacatggccaggcggtccgaatcgtggatttgcgggtggatggtgtcgcacatgcgccgctcgtgggtaccgcagctgaacatgctggtcatcggcgcgatgcccagttgttcgatggcggtgcgcgcattgatatgcgcatcgatcgccatcaccacctgattggcctggcagtcgatatcgaagcggtaggcgccagtggcgcttggcgagtcgagcagggcatagaccacaaaacgcgtggcgttcttgtccggggtttcgaaccagaactgcgtgaaatcggggaattcttcgcgttttttcgcgtaggtatcaatcgccagaccacgagccgagaggccgtattggccggtggagtccactgcgcggaagtagctggcgccgagaaacgacagcacgtcatggcggtccagttccggcgccttgaacagcttgaaaccggaaaagcccaggtcgccggtcagttgcttggtgtccaccgtggttttttcatagttgaacagcgaagggcggaaatgcacttcgcgggcctcgcgggtctttggatcgacactgtgcatgcgcaccggcgtcttgaagcccatgccgacgtggaagaactgcacgtcgagttggccgttcagctctttccacaatgaatggttgccgtcatagccaatggcattgaaattctgcggggtcatgcttgccagggtcggtggcagtacctgtttagtgtcctgatagccacgggtggccaattgcttggcttgcgccttgagcgattcgaaatcgaacgccacggccttgccatcggcggcccggttcccggcccaagcctgcgcggccagcaggccactggccgacaaaccggtgtaagccgcaatggccatggatgctttgagcaaattcctgcggtgcatagagacaacctgtcgtgagcaaatcccgcgccgttcctggcacgtaatggatcagaaataacggttcggacatgccttcggccaaacgcaacggacattaaacagacgccggatagcttaagcggttcgatgcttaaggaaaaatgattgatggcgtgatgatggcgttgcatgtgcaacaagacatttccagcatggcagtcaaacgttacatctggaagcactctagatcgtggctctttggcacttagttttacgctgagggcctactgttcctaccaactcaagtgtctggaggctataaatgaatacccgtggattgctcgatcagttgctcaagtctggccaggacatgttgcaaaacaaggctggtggccaggggaagtccaatgacaaaggcgccctgggtggcttgctcggcggtggcgggctcggcagcctgctcggcggtgccggcggcggcgccctggcagccggggccatgggcctgttgctgggtaacaaaaaggcgcgcaaattcggcggcaaggccctgacctacggcggcctggcggcactgggtgtgattgcctacaaggcctacggcaactggcaggcccagcaggccagcgccccccagggcgagccacaaaccatcgaccgtctgcctccggcccaggtcgagcaacacagccagggcatcctcaaggccctggtggcggcggccaaggctgacgggcatgtggatgaacgcgaacgtgcgttgatcgaaggggaattcaccaagctggataatgaccaggaactgcagcactggctgcatgccgaactcaacaagcccctggaccctgcggacgtcgcccgcgccgccagcaccccggaaatggctgccgagatgtacatcgccagcgtgatgctggtggacgaggagaacttcatggagaagtcctatctggacgaattggctcgccaactgaagcttgagccggggttgaagctggagttggaaaagcaagtacggctcaacacataagttaaggcagccggcacaactttgtaggccaacggtaagcacgatgtgaggcgggccgctcttgatcttgcctttgatcatgatctcaggcgtcccgcctctgtatcccggccgaccccaaggccgccatcgagggcaagccccctcccacatttgaactgaggaccgtcagttagatctgcgtgggctttcgggcctacgagggagcaaggtccatcgccgcaggtgatatccatcctacattttcattctgtgcacgcgccctcaaaagcgttgataaacgcaggcatccgctcagctatactcccctccatttgaatggctctgcgaggaattactgtgaagaactggaccctgcgccaaaggattttggcgagctttgcggtaatcatcgcgatcatgctactgatggtggtgctctcgtattcgcgactgctgaagatcgaagccagcgaaaattcagtccgtgacgatgccgtgccaggggtgtttttcagctcgatgattcgcagtgcctgggtcgacagctacctgcagacccaggaattggtcgggatccacgagaaccagaggatttccgaggaagacaagcaggactacaagtcgttcgaggcgcggcttgagcagcacatggccagctacgcggggacgatcaatatcacccaggatcgcacccaattcgatgccttcgaaaaattgcatcagagttacaacgggattcttgcccaggtcctggcggcccatcaaaacaacaacccggctgaggcgctgagactgttcaacgagcaactgacgcctgcctggaccgcaggccgcatgaagctcaacgacatcatcaatgagaacaaacaggttgctgacaatgccacggccgccatcgatgatgccgttgcggccgcaaaggtcagcatgggcgtctcgctgctgctggcgattctcgccgccgcgttgtgcggcctgttgttgatgcgcgcgatcatggcgccgatgcagcgcatcgtcgagatcctcgaagtcatgcgcaccggtgacctgagcaagcgcctgaacctggagcgcaaggacgaattcaacgttgtcgaaaccggcttcaacgacatgatgaccgaactgaccgccctggtatcccaggcgcaacgttcgtcggtgcaagtcaccacttcggttaccgagattgctgcgacctccaagcagcaacaggccaccgccacagaaaccgcagccaccaccaccgaaatcggcgccacgtcccgcgagatcgctgctacctccaaggacctggtccgcaccatgaccgaagtgtccaccgccgccgaccaggcctcggttgccgccggttcaggccagcagggtctggcgcgcatggaagaaaccatgcactcggtgatgggcgccgccgatctggtcaacgccaagctggcgatcctcaacgagaaggccggcaatatcaatcaggtggtggtgaccatcgtcaaggtggctgaccagaccaacctgttgtcgctcaacgccgccatcgaggctgagaaagccggtgagtacggtcgcggttttgccgtggtagccaccgaagtgcgccgcctggccgaccagaccgccgtggccacctacgacatcgagcaaatggtgcgtgagatccagtcggcagtgtcggcgggggtgatgggcatggacaagttctccgaggaagtacgccggggcatgttcgaagtgcagcaagtcggcgagcagttgtcgcagatcatccatcaggtccaggccctggcgccgcgggtgttgatggtcaacgagggcatgcaggcccaggccaccggcgccgaacagatcaaccacgcgctggtgcagttgggcgatgccagcagccagaccgtcgaatccctgcgccaggcaagcttcgccattgatgaactgagccaggttgcggtcggtctgcgcagcggcgtgtcgcgtttcaaagtctgatgagcgatctcgcggctaagcgcggcgccgttccggcagcgaaaaaagcgttgttcctggtgttccacatcggcaacgaccgctttgccctgaaagccaccgaagtggcggaggtgctgccgcgcctgccactcaaacccatcgcccatgcgcccgtgtgggtggcgggtatcttcgcccatcgcggggcgctggtgccggtgattgacttgagcgccctgaccttcggcacctcggcccaggctcgcaccagcacacggctggtgttggtcaattaccagccgcagccctggagccaggcgcgctggttggggctgatcctggaacaggccaccgacaccctgcgttgcgaccccgccgagttccagccctatggcttggacaaccagcaggcgccgtacctggggccggtgcgcgaggatgcccagggcttgatgcagtggattggcgtcgccgagctgctgaccgctgaagtgcgtgccttgttgttttctgccgagttgagtttatgagcagcgacccgcgtttttcggcgttcttgaaagagcgcatcggcctggacgttgcctcggtgggcgaggcgatcatcgagcgtgccgtgcgccagcgttgccagtcatcccaggcacagtcggtggaggcttactggcagcacctgcaaaattcccacgacgagcagcaggcgctgatcgaagcggtgatcgtgcccgagacctggttttttcgctatcccgaatcctttgcaaccctggctcgcctggcccaggtgcgcctggccgaaatcaagcaaatgcgcgccctgcgcattctcagcctgccgtgttctaccggcgaagagccctattcgattgccatggccttgctcgacgcgggcttggcgccccatcagttcaaggtgcaggggatggacgtcagccccctgtcggtagagcgtgcgcggcgcggtgtgtacggcaagaactcgtttcgcggcgccgatcttgagtttcgcgaccgccacttcaccgaagaggcgggcggttaccgcatcgccgaccgggtgcgcgagcaagttcgcctgcaagttggcaacttgctcgacccgacactgctggccaacgagcccacctatgactttgtgttttgccgcaacctgctgatctatttcgaccagccgacccaaaagcaagtctttgacgtgctcaaggaactcacccacgtggacggcgtgctgtttatcggcccggccgagggtagcctgctggggcgccacggcatgcgttcgattggggtgccgcaatcttttgccttcagccggcatgtagaacagacaccgccggcaccggtatttgtacccatgcccgcgccaacgccgcaacgcagcgcggcaccgataccgcccaagccgcgtccgttcagcaagccccgcccgccagagccaccggccaaagtgccacacaccgatgccggcgagctgctcagccagatcgcgaccctggccaatgaaggcaaaagtgccgaggctcgtgccgcctgcgagcgctatttgagcagccatccaccggccgcccaggtgttctactggctggggctgctcagcgatgtggccggcagcgccctggaggcccaggggtattaccgcaaagccttgtacctggaaccgcagcatccgcaggccttgatgcatctggctgcgctgctcgagtcccagggcgacagtgcgggggcgcgtcgtcttcaggcgcgcgccgcccgtagcgagctgacagtgagtccaaaccatgagtagccctgacgcgctcgacaccgcaggcctggacctgacgctgaccgatacccaagccatcgacgactgctggaatcgcatcggcattcatggcgacaagtcttgcccattgctggctgagcacattcactgccgcaattgctcggtgtactcggccgccgccacgcgcctgctggaccgctatgcgctgcagcaggacgatcatcgcccccaggctgccgtcgaagcggataacgaggcagtcacccgatcactgttgatgttccgcctcggcgaggaatggctcggtattgctacccgctgcctggtggaagtggcgccattgcagccgatccactccctaccgcaccagcgttcccgggcgctgctgggcgtggccaatgtgcgcggcgcgttggtggcgtgcctgtcactggtagaactgctgggcctggacagtaccagtgccggtgccagcggcgcgcgtatcatgccgcgcatgttgatcattgcggctcaggacggcccggtggtcgtgccggtggacgaagtggacggcatccatgccatcgatgaacgcaccctgaaggcggcgtcggcctccggtacccaggccagcgcacgctacacccagggcgtgttgcagtggaaaggccgcagcctgcgctggctggacgaagcgcaattgttgtccgccgtgactcggagcctcgcatgacccccgaccagatgcgcgatgcctcgctgttggaactgttcagcctggaggccgatgcgcagacccaggtattgagcgcgggccttttggccctggagcgcaatccaacccaggccgaccagctcgaagcctgcatgcgcgccgcgcactcgctcaagggcgcggcgcggattgtcggcgtggatgccggggtcagcgtcgcccacgtcatggaagattgcctggtcagtgcccaggaaggccgcctgtatctgcagcccgaacacatcgacgcgttgctgcaaggcaccgacctgctgatgcgtatcgcctcaccgggcaatgatgtgggggcgacggatatcgaggtgtatgtggcgctgatggagcacttgcttgatccgacacagcccaccgccatgcgtgcgccaaagcccgagcctgcacctatcgttgaagaagtgccgcagcaaccggagcccgcaccaccggtcagcagtgaagcgccgcgccagaacaaacgcatgactgaaggcggcgagcgcgtactgcgggtgacggccgagcgcttgaacagcttgttggacctgtccagcaagtccctggtggaaacccagcggctcaagccgtacctggcgagcatgcaacgcctcaagcgcattcaaagcaacggcttgcgcgccctggataccttggacggccagctcaaggccctggacttgagcctggaagcccaggaggccctggccgacacccgtcgcttgttgagcgaagcccaggcgctgctggcggaaaaacacgccgagctggacgagttcggctggcaggccgggcagcgtgcccaggtgctctacgacaccgcgctggcctgccgcatgcgcccgtttgctgacgtgctggccgggcaggtgcgcatggtgcgtgacctgggccgcagcctgggcaagcaagtacgcctggagatcgagggcgagaagacccaggtcgaccgtgacgtactggaaaaacttgaagcgccgctcacccatttattacgcaatgccgtcgaccacggtatcgaaacccccgagcaacgcgtgctggcaggcaaacccgccgaaggcctgatccgcctgcgcgcgtcccaccaggccggacttctggtgctggagttgagcgatgacggcaacggtgtcgacctcgagcgcctgcggggcgccatcgtcgaccggcacctgtcgccggtggaaaccgcactgcgcttgagcgaagaggaactgctgacgttcctgttcctgcccggtttcagcctgcgcgacaaggttaccgaagtgtccgggcgtggcgtcggcctggacgcggtgcagcatatgatccggcaactacgcggcgcggtggtgctggagcagacggcggggcagggcagccgcttccacctggaagtaccgttgaccttgtcggtggtgcgcagcctggtagtggaagtgggcgaagaagcctatgcctttccgctggcccatatcgaacgtatgtgcgacctggcgcccgacgacatcgtgcaattggagggtcgccagcacttttggcatgagggccggcacgttggcctggtagccgccagccagttgttgcaacgcccgccggggcaaaccccatcagataccttgaaagtggtggtgatccgcgagcgtgacgcggtgtacgggattgccgtggagcgctttatcggtgagcgcaccctggtggtgttgcccctggatgatcgcctgggcaaggttcaggacatctctgccggggccctgctcgatgacggctcggtggtgttgatcgtcgacgtcgaagacatgctgcgttcggtggacaaactgctcaataccggccgcctggagcgtatcgcccggcgtagccagcaggccagcgaagcaccgcgcaagcgcgtactggtggtggacgattcgctgaccgtacgcgagctgcagcgcaaattattactcaatcgtggttatgaagtggctgttgcggtcgatggcatggatggctggaacgcattgcgttccgaggacttcgacctgcttatcactgacattgatatgcctcgcatggacggtattgaattggtcacactcttgcgtcgtgacagtcgcctgcaatcgttgccggtgatggtggtttcctacaaggatcgtgaagaagaccggcgccgtgggctcgacgccggtgccgactattatctagccaaagccagtttccatgacgacgccttgctcgacgccgtggttgaactgatcggaggcgcccggacatgaggattgcgatcgtcaacgacatgcctctggccgtggaggcattgcgtcgtgccttgagtttcgagcccgcccatgaggtggtgtgggtggccagcaatggcctggaagcggtgcagcgttgcgccgaactgaccccggacctgatcctgatggacctgatcatgccggtcatggatggggtggaagctacccgccagatcatggccgacacgccatgcccaatcgtgatcgtcacggtcgaccgccaggccaacgtcagccgcgtattcgaggccatgggccatggcgccctggacgtggtggatacgccggcgctgggtgtgggcaaccccaaggatgcggccgcgccgttgttgcgcaagatcctcaatatcggctggctggtcggccagcgcggcagtcgcgtgcgtgtcgaaaccccgacgcagcgcatcactggcaagcgtcaacggttggtggccattggttcttcggccggtgggccggcggccctggagatcctgctcaagggcttgccgcgcaatttccccgccgccatcgtgctggtgcagcacgtggaccaggtgttcgccgcgggcatggccgaatggttgagcagcgcctccggcctgccggtacgcctggcctgtgaaggcgagccgccgcaaaccggggtggtattgctggccggtaccaaccaccatattcgcttgttgaaaaatggcacgctagcctatacggcagagccggtgaacgagatctaccggccttccatcgacgtatttttcgaaagcgttgccagccattggaacggcgatgccgtcggtgtcttgctgaccggcatggggcgcgatggcgcccagggcctcaagttaatgcgggaacaaggatatttgaccatcgcccaggaccagcagagttcggcggtgtatggcatgcccaaagcggcagcggcgatcgacgctgctgttgaaattcgcccactggatagaattgcgccccgattgctggaggtttttgccaaatgaacaaaaatctcccgccgtgctggcttgcaggtagtaattcaggtgattgcacatgaatgatttacagctcgacgacttcaagaccgacgaaaacgccgccatggtgttgttggtcgacgaccaggccatgatcggcgaagccgtgcggcgtggcctggccaatgaagaaaacatcgacttccacttttgcgccgacccgcaccaggcgattgcccaggcgatccgcatcaaaccgacggtgatcctgcaagacctggtaatgccgggcctcgacggcctgaccctggtgcgcgaataccgcaatcacccggccaccgcgaatatcccgatcatcgtgctgtccaccaaggaagacccgctgatcaagagcgcggcctttgccgccggagccaacgactacctggtcaagctgccggacaacatcgagctggtggcacgcatccgctaccactcgcgctcctacatgaccctgttgcagcgcgatgccgcctaccgcgcactgcgggtcagccagcaacagctgctggacaccaacctggtgctgcaacgcctgatgcactccgacggcctgaccgggttgtccaaccgccgccacttcgatgagtaccttgaactggaatggcgccgcgccatgcgcgatcagacccaactgtcgttgttgatgatcgacgtggacttcttcaagacctacaacgacagcttcggtcacgttgaaggcgacgaagccctgcgcaaagtcgccgaagccattcgcgatgccagcagccgcccttcggacttgccggcgcgctacggcggtgaagaattcgccctggtgctgcccaacacctcgccgggcggtgcgcggctcgtggctgaaaaactgcgcatggccgtggccgcgttgaaaatcccgcacaatgctccggtggaaggttcgagcctgaccatcagtatcggcttgtcgaccttgacgccggtgcagggcacggactgccggcaactgatcatggcggcggacaaggggctgtatacggccaagcataatgggcgcaatcaggtggggattgagtgagttggggccagcgtaactccaggtgaggaattaaggcccatcctacacctggaatttcaaggcttgtgagttgagtgcgaatggagaaaggttgaaacaagaactccgccatcaatgcctagccgatgacggagtttgccggagcgttactctactttaaacccaggcttaccattagcggcgcgccattctttgacttcttttacgatgccttcagggctgtcttctctgtcatctctcggatagtagacgagatctgatccgtcaggatgttctgtaaggcgcgtgaactctaatagtatttcgtcatcttcttcctcagtacgagcactcgcgtcacaaagagaaattacgaagtttaaaaaatcggtttctgtgtactcggaaattgaagttttcatcttaattacctttaccgtgaatacgcttgtgaagttttggaacatgcctgaccatcagtattgggctgtcgacgttgacgccggtccagggtacggactgccggcaattgatcatggaggcggacatgggtctgtataccgccaagcataatgagcgcaatctggtgggtatcgagtaatctgagatcgcagcaagtccacatggggtggagggggcttcctcactttggatgttcgtgttccttgaactgccgttggattaaaaaactgccatcgatatcgaatcgatggcagaaatttgtagaagaatattattctgctttaaatccgggcttatcattagcagcgcgccaatctttaacttcttttacaatgccttctgggctgtcctctctgtcatctcttgggtagtaaattaaatcggctccgttcgggtgctccgtcaggcgttcaaactcgaaaaccatttcaatgttttcttcttcggtgcgaacgctgctgtcacaaagtgagattacaaagttcagaaactcggtctctgtgtattcagtgattaatgttttcatctttttagatatcttttctatgaattcctttatggcgttttttggtgattatatagatgttgtcaatgtcaaaactctcgccgccttgagaaatgaaaattttgtgatgaatttcgaatttaacagatttccccacccattctgatttgcttgaaaagggagctttcccatccagcattatcgacaaattttggcgtttgaactgacttgccagttccgagtcgttggcaaccgttttccagaaggcttcgcgaaatgctctgaattttttaaattcctggcctcttaggttattggggatttgcgatggtataggggcaccctcaccttgtgaggccgcttatagcttgctcgcactggagctttagggacggcgggctgaatgcaaaatgaagaatggttgaaataatagctccaccatcaatggccaatagatggcggggctttttggggggttactcttctttaaagccaggcttaccattagcctctcgccacttttcaactctttcggttatagcctcaatcgtactttccgcatccgatggggcgtaataaataaggtctgtttcttctgggtgttcagtaattaactcgaaatgttgtaaaagcttgtctagttgcttatctgttggtgcggtgttttccttgattatttctttcattaatagcgaaaattcttcttttgtatactctgaaaagcttggtttaagtttcattgttcggttcctttcttatgaagttccatatggcgtttaggggttggtatgcgcaagttttcagcattataaacatcaccacctttcgaaatttctgtcagatgatgaatttcaaaggacgtgcggcttcctagcgaccagggcgagtgaaagagccttgagttcttgtgcggccctccagacgctatcgtaaagtgcatatatatcgctcaggtttattgctgggtcggcagacgccagtgtttcgcgaagctttgtgtaggttaaattttccatcaggtaaaaagggctctgatcataaagaccatagatgagtggtgcgttactcatatattttgtttttttggcgctgatgatttccaacgcgattttttgatcgataacggctgactctctatcagtgaggtgttgggaggctttcgccgcctgctgctgctctttgagttcgcgttcagtctcggtattgagtattgcgaatcgtgctttgtactctgcatcaatcaaggattggttgtacttttgctctccaatgaaatctgctgtggtgctggggaagtcgaactgcttgaagcggctacggtctccttcgcctcggcgtgggccttcctgaaggtcccatccatctccgctaccgatataaccgccgccttcgccgccccaataagtgtttcgtctcccagctgtaattatcgttggcttgagtactaacggttgtcctggctgccacccttgttgtgccatgtgtctctccgctttcttgtgagagtgatctggttttgagatgtgtgcgtgctgaagaaaaatagcttcagtcgctttgattaaacttatttgagcaggaaggaagaaaaaactgatggcgttttgatgcggtcagaggtttgtaggacgctttgtaagtttggtgtgaaaccgatgtatttatattctgatatatttgtaggttgcgtcttaggacggtttgtctggacgtctaattgtttgtttttgctggaggtaggtgatttagaattttccaagttgtctctgatgttggttttaagcttttttgtataaacagatgaacggtctgtttttaaccagtaatagagtctggttgctctaacggtagacgccgccagccgacgcgaaatgggtggacgggtgccttttactgaatcaagcgaaacggcagcaatcaggatttgatccagagggcagcgccgccttggcagaatcgaccaagcgggctgccgctgccgcccgtttgccgttatactcgccggctttcaaaagttcgccaacgagtgctgcccgccatggaaatcaacccgatccttaacaccatcaaggacctgtccgagcgctccgaaactattcgggggtatctttgactacgatcaaaagcatgagcgtctgaccgaggtcaaccgcgagcttgaagatccgagtgtctggaacaaacctgaatacgcccaggagctggggcgcgagcgctctgcgctggcgcagatcgtcgataccctcgatgaactgaacaccggcctgggcgattgccgtgacctgctggacatggccgtcgaggaaaacgacgaaggcgcagtgggcgatgtcgtcgccgagctggcccgtcttgaggaaaacctcgccaagcttgagttccgccgcatgttcagccatgaaatggacccgaacaacgcctacctggacatccaggccggttccggcggcaccgaggcccaggactgggccaacatcctgttgcgcatgtacctgcgctgggccgacaagcgcggtttcgacgcgaccatcatggaactgtccgccggtgaagtcgccggtatcaagggcgcgaccgtgcatatcaagggtgaatacgcctttggctggctgcgtaccgagatcggtgtacaccgccttgtgcgcaagagcccgttcgactccggcaaccgtcgccacacctcgttctctgcggtgttcgtctcgccggagatcgacgacaaggtggaaatcgagatcaacccggccgacctgcgcatcgatacctaccgttcctccggtgctggtggtcagcacgtaaacaccactgactcggccgtacgtatcacccacgtaccgaccaacaccgtggtcagttgccagaacgagcgttcccagcatgccaacaaggacaccgccatgaaaatgctgcgggccaagttgtacgagcaggaaatgcagaagcgcaatgccgcttcccaagcgctggaagacaccaagtcggatatcggctggggtcaccagatccgttcgtacgtgctcgatgcgtcgcggatcaaggatctgcgcaccaacatcgaacgcagcgactgtgacaaggtgctcgacggcgatatcgacgaatacctggaagccagcctgaaatccggcctgtaacaccctatgtgggagcgggcttgcccgcgatccccaggccgcaggcctgggggcaacgaacctgtgatggaaaatttaaagacatgagcgaccaacaactcgacccgcaagccctgcaacaggaagaaaactccctgatcgccctgcgcaaggaaaagcttgctgccgagcgcgccaagggtaatgccttccccaatgacttccgccgcgacaactactgcgatgccttgcagaagcagtacgcggacaagaccaaggaagagctggcagaggctgcgatcccggtcaaggtggcaggtcgcatcatgctcaaccgtggctcgttcatggtgatccaggacatgaccgggcgtatccaggtctacgtcaaccgcaagaccctttccgaagaaaccctggcctcggtgaaaacctgggacatgggcgacatcatcgccgccgagggcaccctggcccgttccggcaagggcgacctgtacgtcgagatgaccagcgtgcgcctgctgaccaagtccctgcgtccgctgccggacaaacaccacggcctgaccgacaccgagcagcgttatcgccagcgctatgtcgacctgatcgtcaatgaagacgtgcgccagacgttccgcgtgcgttcgcaagtcattgcgcacatccgcagcttcctgatgcagcgtgacttcctcgaagtggaaacgccgatgctgcaaaccatcccaggtggtgccgcagccaagccgttcgaaacccaccataacgccctggacatggaaatgttcctgcgcatcgcgcctgagctgtacctcaagcgcctggttgtcggcggtttcgagaaagtgttcgagatcaaccgcaacttccgtaacgaaggtgtctcgacccgtcacaaccctgaattcaccatgttggagttctaccaggcctacgccgactacgaagacaacatggacctcaccgaagaactgttccgcgagctggcacagctggtcctgggcagcaccgacgtgccgtacggcgacaaggtgttccatttcggcgagccgtttgtgcgtctgtcggtgttcgactcgatcctcaagtacaaccctgagctgacggctgacgacctcaatgacatcgacaaggcccgcgccatcgccaagaaagccggggccaaggtgctgggtttcgaaggcctgggcaagttgcaggtgatgattttcgaagaactggtggagcacaagctggaacagccgcacttcattacccagtacccgttcgaagtgtcgccgctggcccgtcgcaacgacgacaacccgaacgtcaccgaccgtttcgagctgttcattggtggccgtgaaatcgccaacgcctactccgagcttaacgacgcggaagatcaggccgagcgcttcatggcccaggtggccgacaaggacgccggcgatgacgaagccatgcactacgacgccgactttgtacgtgccctggaatacggcatgccgcccaccgccggtgaaggcatcggtatcgaccggctggtgatgttgttgaccaactcgccgtcgatccgcgacgtgatcctgttcccgcacatgcggccacaagcgtaaccgtagcgaaaaccgaagccgccttttataaggcggcttttttatgtggcgtattcaagcgtcaagcgaacagcgccaggttttgatctattcaaggatgtgtttggtgaaccgcgtaatggctcaagaaggtgccgccggcatagctgctgccgtggctgaaagcgttcaatatcaaggccgcaaggccagccgccggggcagtgagcaacgccgccaggacattctcgatgcggccatgcgcatcgtggtgcgcgaaggcgtacgcgccgtgcgccatcgggccgtggccgccgaggccggcgtgccgctgtcggccactacctactatttcaaggatatcgacgacctgcttaccgacaccttcgcccagtacgtcgaacgcagtgccgcgttcatgggcaagctgtgggtgcgcaacgagggcttgctgcgcgagatggttgcctatggcgatggcagcccacagtcgcgttcgcaactggccgatgacatcgcccggctgaccgccgactacgtgctgcgccaactgaccaaccgtcgcgaatacctgatggccgaacaggcctttcgccaagaggcgctgttgaacccgcgcctggccgagctggtgcgttcccaccagcagatcctgttgcagggcaccgggcagtttttccaggtattgggctcccgtgagccgcaacaggatgccaaagtgttgacggctattatcagtcggatggaatatcagggcctgcttggcggcccagagccgctgaccggcgaagagatgcttgaaatcctcaagcgttacatgcatttggtgctggcttcggtctgacaccgggggatgtccaatgaaagtctggcgcgtcgcggtaatcgccttgttggtcctgttgctcagcggttgcctggtgactttcaaggaaccattgccgacggctgaagccgcgccagaggctctgctaggcaagtgggccagtaggaatgcctggggcgagccgctcaacctgcagatcacccgtgccggcgagcatcgttataaagcggtgagctaccctaaagccaagccgggccagcgcgatgagtatctgtttagcgtctcgcgccacggcagccgctggtatctgtcggcgccgctgcctgcaagactgggcgggcatttcatcctggcgggctttgagtttgatgaaaagcacgaactggtggtctacaacctcgacctcgaacagatccaccaagccattggccagcaggccttgcacggcggcactgtagacaccgtcgaaggcgccggtgtgctggtggacagccccatggaccaggtgtttgcctacctggatgacccggccaatgccgatgtgttcgttgaagccgtgcgctaccggcgcgtgggtaaataacgtttaaagaggaagcaccgggtggacgaataccagcagacgatacgcaccttgtccgatcgcattgtgctggcgcaaacaccgatccgtgtcctcgatgcggtgaaatgggacgagaatatccgccagggatttctcaaggccaagggcaaggccatgcctgccgtagaccgcgattactacctgaaccggcctctgtcgttcgactccagtgcggtcaagctggagttccagaacatcgagcgcgacatcacccgtcgccttgggcagttcagcccggtggggcagatcatgcgtcgcatgtgccgtgaataccgcatggtggtgcgcatgctcgaagcacgcggcaccgaggatttcggcctgatctcccaggagctgtatggcgccgcttccgatgccttccacgctggcgacccgaccctggcggacctgggcctgatgctgtccgactacctgaacaatatcgatggccgtggcgacctcaaggacgaagccaagaccctcacggccaaggatgcggtcagcctgctgcaaacgcgcttgaacaaggtatttggtgaagcggaggaaaccatccgggtgttcgagtccgacgggatcgtcgccgatgcggcagccggcgccgactacatcaagatccgcgccgacgcgatgttcaacgaccgtgacgtgcgcgccctggaggtgcatgaagggctggtgcatgtgggcaccaccctcaatggccagaaccagccgatctgcacgttcctgtcaaagggcccgccgtcgtccaccgtgacccaggaaggcctggcgatcctgatggaaatcatcaccttcgcctcttaccccagccgcctgcgcaagttgaccaaccgcacccgcgccatccacatggtggaggagggcgccgacttcttgcaggtgttcgagttcttccgcgagcaaggctttgaaatggccgagagctatggcaacgccagccgggtattccgtggctcggtgccgaccggactgccgtttaccaaggatttgtcctacctcaagggctttatcatggtctacaactacatccagcttgctgtgcgtaaaggtaagctggagcaagtgccgttgttgttctgcggcaagaccaccctggaagacatgcgcaccctgcgccaactggtcgatgaaggcctggtgataccgcccaaatacctgccggagcagttccgcgacatgaacgcgctggcggcgtggatgtgcttctccaacttcctcaaccatttgagcctggaccggatcgaggcggattactccaatatcctttagggggtctccaagggacttcatatttgttagcgaggtttcaacggatgagaatcctcggcattctatgcctgctacttacactcaatggctgcagctccttgctgttctaccctgaacccggcctgccgtttacgccggaaaaagcccgcctgcaataccgcgacgtcaccctcaccaccgccgacggcatcaagctccacgcctggtggctgccggccaaacccggtgtgccgctcaagggcacggtgctgcacctgcacggcaacggcggcaacctgtcctggcacctgggtggcagttggtggttgcccgagcagggctatcaagtgctgctgctggactatcgcggctatggactctcgcaaggcaagtcgtcgttgccggcgatctatcaggatatcgacgccgcgttcagctggatcgacaaggcgccccaaacccagggccaaccgttgattgtgttgggccaaagcctgggcggcgcactagccgtgcattacctggcagcccatccggagcgtcaacgccaactcaaggccttggtgctggacggtgtgccggccagttatcgtgacgtaggacaattcgccctgagcacttcatggttaacctggccattccaggttcccttgtcttggttggtgcccgacgccgacagtgcgatcaacaccatgccccagttgaccggcgtgccaaaactgctgtttcacagcctggatgacccgatcgtgccggtgtccaatgggctgcgcctatatcaagcggccccaccgccaagggtgctgcaactgacccggggcggccatgtgcagacttttgccgacaagacctggcaaaccgtgatgctgcgttacctggacgatccacagcatttcaatggcctgcgtcgcctgggcgaaatcccgaattatccaacctctaaagttgatccatcagagagcccgcaatgagtgaagaacgcaacatgatcccgctgatcctcaccggtatcggcaccatcatcggcaccgtcggctgcctgtggtactacggctatctgcatttcgccaagccggaggatgcgttgctgctcagtgacttcaccatgctcaagaccttgccgggtgaggattacaaaatatccctgacgcccgctgcgcaagtggcgcagtgcgtggacggtgtgttggtgatgtttgataccgaacagaaaggcttgagcggcgtactggtgaataacaagaagcaggccgttcgttgcatggggcaggaaaccccacagttgcaacagtgaagcgccgcaccgctgttgtgggcaaactccgttatacaggccgattagtcatttaaggctgctgcgatacgttgcaggctggaaccactttggcgcacttgccacagattgtgtactgattggcttgaccgatcagttcacgtattcattaatctggagcaggcaattatgggtggtgtcagtggtgtacagggcgcaggcaatgttggcaatcagggcaatgtcggagaggcgcagcaaacccctgcccagcaaattcaagacattaaagagcgaattgccaagtttgaggaaggcgcccaaggcgggcaggggggcggcggcagccagggggccggaggtgcccaaggagctggcggtgcccaaggatccgggggcggtgaaagccttgaagacctgctcgaaaagctgaagcaattgcttgcgcaattaggtcaaggcggtccggatggcgcgcagggtgagggtcagattcaggcgggcgcggccgaaagccagggcccgatcaacttttgattcacggtgattcgataacccgccagttatgggcgggtttttaatgcgtgcagggatgaagcgtgccgttccagtcgctgttggctggaggtcgcatttgacgaaattatctggaactgttttgtgtaaatagccacagagggcatataacttttacacggagcggggccgggaagcagtgataaatattgatgcaatacacaacatggtcgccatggccagggcacatcaggcgttggagcggcaaaacgcgcaagagcaggcgcgtaacaactggacggacgatttggccgatacctcccgtagcagagcaatgataacgccgccagatgaagatacagatcgcacgatcaagtattcctgagcaaaaaaaacccaccataaggtgggtttttttatccagcatctaatgatcaataagcaacggaagaccgtggcttgaccggctggttatcgttggagatggtaacttcaacgcgacggttcatggcacggccagacacgctgccgttgtcggcaaccgggtattccttgccgtagccctgggtcacgatgcgcgagatgtccacgccttgttgagccagtgcacgttgtacggaagcggcacgacgctcggacaggctctggttgtacgagtccgaaccggtgctgtcggtgtagccttcaacgatgactttacggtccggattatcgcgcaggaactgagccagcttggtgatgttcaccaggccgctggatttcaggtcggacttgttggtagcgaacagcacgtcaccgaaagtcaccagggtgccacggtcggtctgcttggcattcaagctgttttgcagttgcttgatctgcgcatcacgggcgtcgagcagggcgcgggcacgttcgtcgccagcgtttttcagcttggcttcgttttcgcgcagggcgatggtgtccttggcgacttcaacgcgctggttggtcaggtaggcgagttggtcgaccttcttctcgtcttccttgtcgcggtacgccttgtcagccttgtccagccattcgctggcgtctttggtttccagtgctgccagcttggtggcttgcgggttggtttgcagggccgagaagttggtccgtgcattttccaggttcgcgttcggcggggtggagcaggccgccaaggcaacgctcatcgccagcagggcagggatcatcagttgtttacgcatagtcgtgtcgtcctttcaattcgatatcaggtgcgatgcagtcaaggggctgcggcttacttctgctggatagcagccgggcgcatgccttccttacgcagctcttcaacagccttctgggagtccttcacagcctgttcagccttggcagcctgggctttacgctcagcgacgcgagcgtcccactcggcctgctcggccaacatacgagccttgtcgtagttcttgtcgtgcatggccagttcagcttccttgagcttgtcctgggccgccttcatttccacggcagcgtactcggtgccgccggcgctcacggcgctgttgacagccgattgagtcacggcgtactgctcggttggagggttgccggcgcagcccgccagaacgaagctggtgccgattgccagcgcggccaatttgagcccgcgcaggtggttaaacgaggatttggcagtgctggtgttcatcgtcttcaactccattggataactcctgaaaaacatcaaaatccatcgtggcgtatcgattgcggccccggcgataaagcacatgacgccagtttcaaacgaccgttccaagtgatggcttactggctgtgaccggcggcttttttcaaaagttcagagaagatggcgatttgcctaaaaaaatatctgactgatcggtcagcgtttaaacatggaactttcagtgctcgcagaggtagaccgagcctctaagaggcccggaatacttgattcagatgggcactgcgggtgtatatcagtgcttttgttcgtcggcactggctgacagatcatgcagataacggcgcgacagactaagaaaacgtggagtgggcccgacgtcttcatacagcgggtcaccttcctcgtcggtggcaatcacttgctggcccttgatataggggaagctggcttccagctcttccagggcggcaccgatcagctctccgagcaattcctcggtgtggcgcttggggtacatctcggcaagggcagccaagcgtgccgcggattcaacgtccagatgaatcgcgtattcagtctgggtcaggcgacccttggcggtttcttcccagtgctggggcagttctcgaatcttcatggcaacctcaatgagcctgcgatggcaggcggtgatgagtgaccagccgcctgcttggataacgtggcggctcactcttgagactagctgtcagccacaaggtttaaagtcgtttgcgttcagccttgtcagataccgacgcgggcggcactctggaacacctgcgcgtcccggatttctggctggagattggctgatgagtgatatcgatgcacgcttgcgtgaggatgttcacctgctgggtgagctgttgggcaacaccattcgagagcagtacggcgatgatttcctcgataagatcgagcagatccgcaaaggcgccaaggccgatcgtcgcggcgctggcgatgaactgagcacccgtctgaaccagttgcaggaagacgaattgctgcccgtggcccgggccttcaatcagttcctcaacctggccaacattgccgagcaatatcagttgattcatcggcgcgatgagtcgcaacccgcgccgttcgaatcccgagtcttgccggagttgctggcccgtctgcaaggcgaggggcacagcaatgaatccctggcccgccagttggcacggttggagattgagctggtgctcaccgcccaccccactgaagtggctcgccgcaccctgatccagaaatacgatgcaatcgccgcgcaactggccttgcaggatcaccgcgacctcaccagtgccgagcgcgagcagatccgcacacgcctgcaacgactgatcgccgaagcctggcataccgaggaaatccgccgcgtccggcccaccccggttgacgaagccaaatggggcttcgcggtcatcgagcattcgctgtggcacgccatccccaattacctgcgcaaggctgaccaggccctgtttgccgctaccgggctgcgcctgcccctggaggcagcgccgattcgctttgcatcgtggatgggcggcgaccgtgacggcaacccgaatgtcaccgcgccggtcacccgcgaagtgctgttgttggcacgctggatggcggctgacttgtatttgcgcgacatcgaccacctggcctccgagttgtcgatgcaacaagccagcccggcgttgcaggccaaggttggcgacagcgtcgagccctatcgagccttgcttaagcaactgcgtgagcgcctgcgtgcgacgcgccagtgggcccacacgtcgttgaccgccaccacagcggcgcctgccgaggtgttgcaggacaaccgcgacctactggacccgctggagttgtgctaccagtcgctgcatgaatgcggcatgggcgtgattgccgatggcccgctgctcgactgcctgcgacgcgccgtgaccttcggcctgttcctggtgcgcctggatgtgcgccaggattccagccgccattgcgcggccatgaccgaaatcaccgactacctgggcctgggccgttatgaggactgggaagaagacgcgcgcatcagcttcctcacccaggagctagccaatcgtcggcctctgctgccgggctatttcaagccgtcggcggacaccgccgaagtgttgaatacctgcaaggaaatcgccgccgcaccggcggcatcattgggttcgtacgttatctccatggcgggcgccgcgtcggatgtgctggcggtgcagttgctgctcaaagagtcgggcgtacaacggccgatgcgcgtggtgccgctgttcgagaccctggccgacctggataacgccgggccggtgatggagcggctattgcaactgccgggctatcgcgcacggttgcagggcccgcaggaagtaatgatcggctactcggactcggccaaggacgccggtaccaccgctgcggcctgggcgcagtaccgggcgcaggagcggttggtggatatttgccgcgagcagcaggtggagctgctgctgttccacggtcgcggcggcacggtcggccgtggcggcggcccggctcacgcggcgatcttgtcgcagccaccgggctcggtggcggggcggttccgtacgactgaacaaggcgagatgattcgcttcaaattcggcctgccggatattgccgagcaaaacctcaacctctacctggctgccgtgctggaagcgacgttgttgccaccgccgccaccggaaccagcctggcgtcatctgatggatgagttagcggccgatggtgtcagcgcttaccgtgccgtcgtacgggaaaacccgcaattcgtcgaatactttcgccagtccaccccggagcaggaactgggccggttgcccctgggcagtcgtccggccaagcgtcgggccggcggtattgaaagcctgcgtgccattccgtggattttcggctggacccagacgcgccttatgctgcccgcctggctcggttgggaagcggcattgagcaaggcgctggagcgcggtgaaggcccgttgctggggcagatgcgtgaacagtggccgttcttccgcacgcgcatcgacatgctggaaatggtgttggccaaggcggatgccgatatcgcccgtctctatgatgagcgcctggtgcaggcggacctgctgccattgggcgcgcatttacgcgacctattgtcgcaggcatgtggcgtggtgcttggcctgaccgggcagtctcagctgctggcccatagccccgacactctggagttcatccgccttcgcaacacctacctcgaccctttgcacttgttgcaggccgagttgctggcacgttcgcgtcaacaggaggcggcgcaagacagccctctggaacaggcgctgctggtgtccgtcgccggtattgccgccggtttgcgcaacaccggttgaggtttcttgcgagttctcaacggcttgcggataaacccccatgaccgccctgaaaagggcggtcatcgtttgagagggcgggttgcgctcaggcacaccccgtcgctgacgcatgtcgggcgcgggtttctcctacttttggcggcttgtatggtaagggcccgctgtgtatcttgatcagcctttggccgtttgatcggcctggaaccacatttttacgagattggccccacgcggcgaatccgagcgtcatctctataaaaaattgaggagcacatcgatgcgcgtcattctgctgggagctcccggggccggtaaaggtactcaggcaaagttcatcactgaaaaattcggcattccgcaaatctccaccggcgacatgctgcgtgcggccgtcaaggctggcaccgagctgggcctgatcgccaagagcgtgatggacagcggtggcctggtctccgatgacctgatcatcaacctggtcaaggaacgcatcagccaggacgattgcaagaacggtttcctgttcgacggcttcccacgcactattccccaggctgaagccctggttaaggcgggtgtggagctggacgccgtggtcgaaatcgcggttgaagatgaagaaatcgtccagcgtattgccggccgccgtgtccacgaaggctcgggccgcgtttaccatatcgtctacaacccgccaaaagtggaaggcaaggacgatgtcaccggtgaagacctggtgcagcgcaaagacgacaccgaagaaaccgtgcgtcatcgcctgtcggtctaccactcccagaccaagccgctggtggatttctaccagaagctgtccgcagcccaaggcaagccgaagtacagccatatccctggcgtgggctcggtagaagccatcaccgccaaggtgctgcaagcattgagctgatccagtcatcggctttacctacaacggcccgcttgcgggccgttgttgtttatactggcgcactttttttccgacttggacacctacaccgatgagcaccctgctggccctggacaccgcgactgaagcttgctccgttgccttgctgcacgatggcaaggtaacgagccactacgaggtgatcccgcgcctgcatgcgcagaagctgttgccgatgatcaagcagttgcttgaagacgccggcaccaccctggcgtgtgtggatgccatcgccttcggtcgtggccccggtgcctttaccggcgtgcgtattgccatcggcgtggtgcagggcctggcctttgcattggagcgtccggtattgccggtgtccaacctcgccgtgctggcccagcgcgcattgcgtgaacatggcgccacgcaagtggcggcggcgattgatgcgcgcatggatgaagtttattggggttgctaccgccagaccgccggcgaaatgcgccttgtgggtgtggaagcggtacaggcgccgcaagtggtgacattaccggatgacgccagtggggattggtttggtgccggcacgggctggggttatggcgaacgcatcaaggtgcagttggcaggacgggacgctgcgatgttgccccatgccgaagatttgctggcattggcacggttcgcattcgagcgcggcgaggccattgcggcagatcaggctgcaccggtttacctgcgcgataaagtggcgcagaccaaggccgaacgcggaattatttgacgtcaagaatgtaggcattcggtggcaaatttcgccaatcgtcagaatttgccgcagtttttaaaccttttacgaattatgtgttctagttatcaccagagcatttgcgcaccacggaaagtgccgctaaattgccatcattgataccgagtctgcatgtatgcgtatagacggcttttcctcacagtcctacccactcaagcgtaagccgcgcaaggcgaacgtgacggtagatgattcggtcgaggattcgccggacttcatcgaagtccactctgagtcgccctcccgcgcccaaagtgctggcggcgcccgtaccagcggcgttcccgcccgtcagcaagacatggtcttcccccgctccatgagcaaaagcgttgccaccgccttggccagctacctgaccactgccggtttcgtcgagtgggatatggaagttctgggtctcgatatccatatctgatggggttgccttactacatcggctgcccgtcctggagtgaaaacgcctggcgcgaatacctgtatcccctggatgctcgctccggcgattacctcgggctctactcccaggtcttcaacgctgttgaaggcaataccacattctatgctcgcccgtcggccgccacagtacagcgctgggctgacatcatgcccgatgactttcgcttcaccgccaaattccccggggatatcagccatgccggcgacttgcgtgagcaattgccggcggccgaaagttttgtcgggctgatgagccctctgggcgcgcgcgtttcgccgctgtggctgcaactttccaagggttttacaccgcaacgcctccctgagctggcggggttccttgatggcattgatcgtccgctggccgtggaggtcaggcatgagcagttcttcgccaaaggcgacgccgaacgcatgctcaaccgccttttgcgtgaccgtggcgtcgaacgcatctgcctggatccccgtgccctgttcagttgcacctccacgtcggcggcggtgctgcatgcccaggcaaaaaagcccaaggtgccaccgcgcccggcggcgctgacccagtttccccaggtgcgttttatcggccatccgcagcttgaggccaacgacccgttcctgatcccgtgggtggaaaagatcgccagctggatcgaagaggggcgtacgccctacatgttcctgcacacctcggataaccgcctcgctgcacaactggccctgcgctttcacgccaagctgatggtgcgcctgcccgggttgccgccgctgcccaccttgcaccgagcgcccgaagcggagcaactggggttactctaaggctccttttctcgccaggagtcagtcatggatgcccaaaccctacgcgccgaaaccttcaaggccctgcatgaacgtgaccgcgcgtttgtgatgcccaacccctgggatgcgggctccgcgatcatgctcgccagcctgggcttcgaggcgctggccaccaccagcgcgggttatgcattcagcctggggcggccggatgcgcagggcgctctgaccctcgaggacaccctgctcaatgctgaaatgatcgccaacgccaccactctgccggtcgcggcggacctggaaaacggcttcagtgatacccccgaaggctgcgcccaggccatcttgcgggcggcggccagcgggattgtcggtggctccatcgaagatgccacgggcattgccgtagacccgatctatcccttcgatctggcggttgaacgtgtggaggccgccgtcgccgccgcccgcagtttgccattccccttcaccctgaccgcccgcgcagaaaatctcctgcacggtcacctggatctgccggacaccctcaggcgcctgcaggcctttgctgaggccggtgccgacgtgctttacgccccgggcttgcgcagcgccgaagaggtgctggcggtggtcaaggctgtggcgcctaaacccgtgaatgtgttgatgtccggtggccttaagctcagcgtggcgcagttgagcgcgatgggcgtcaagcgcatcagcgtcggctcggccatggcgttggcggcgtatggcgagttctatcgcgctgcccgggaagtccatgaacagggcacattcacctttaccgagcgttcgatgtcttatgcccaggccactcaattcttcaagggctgagccgtgggcgggataaaagtgttgggtgcgttgctattgctggcgtgcgcgttcgcgctgggagtttggcggggctgggtgccgatgccggctgaatggaatccctgggcacctttggatgtgcgcgccagcccgaacctgctgacgcgctacaagctcagccgtttgcaagatgatccggcgctgtgcgaccaggtattgcaaacctccggcctgcgggtaagtcgccaggcggacaccgcggccgatacggcgtgccccttgcgcaatatcttgcgggtgcagggcgctgacgttgtcttgagcagcagctttctcgccagttgcccgctggccgtggcgttcgccttgttcgagcgccacagcctgcaaccggcggcccaggcgatttttggccaacgggtgagtcgcgtcgagcatttgggcagctttgcctgtcgcaatgtctacaaccgagccgaagggcgactcagtcagcacgcctcggccaatgccctggacatcgccggttttcgcctggcggatgggcgcagcatcagcgtgctcaaggattggccgggggagggtgacggtgcgcggttcctgcgccaggtacgcgatggcgcttgtgatgatttcaacgtggtattgagcccggactacaacgcggcgcatcgcaaccactttcatctggatatggggcggtggtgggcgtgtcgctgaggtttaagcggccaggcgcaggttttgggtaaccagcgggcgtgcccagtagtagtcgaaatccaaggccttttgttgtgccacaagctcttcttcagggtacggcgtagcagctggtggcaacagatccagttcgaactcggcaattggcaaatgcagtgggcgtggctgcggcgccgggcctggggctggcagcggttggccggcattcaggacaatcggccgtacccagccactgtcgaaatcctgcaggcgctgctgggcgatgatttcgtcttccgggaacggtgtcgcggccggtggcagtagctcggtttcgaattcggcaatcggcaggaacagcggttcgggcggcgcgatctcggtgtctttgacctcgcactcgcgttgggtgaggatctgcgacaacaggtcggcgccttcactgggctcgaccgctgggtccagcggtgctggcgccttggcggccagcgcctgcggcgtttcaccgagctgctcggccaatgcccgggcgaagaagtcctgccacacatgactcaccccggccagcgcttgggtattgcgcaggccgtaatggttgtgggtcggcagtacaccgatggttagaggaagaatgtctgacatttttctcggtcgtcgctcagctctggcaaaatacctgactgttgtttttatcggccgtttttggccgatccttaatattttcgagcgtagcgattgatgagcgaacaaccagcggccagccgcatccaggtcgaggcgttggccgacagtttccaggcccgcgccgagcagtgggctgcgctgctgggcttgcccctgcaggtggtggatgcggatttttccctgcaagtcggggaacagggcctgcaactgcaacagcttgggcctgatgcgccggggcccgtgcgggtcgactttgtcgaagggggcgcggcgcaccggcgtctatatggcggtggcagcgggcaaatgatcgccaaggccgtgggcatcgctcaaggcgtgcggccccgggtactggacgccacggccggcttgggcaaggatgcgttcgtactcgccagcctggggtgcgagatgagcctgatcgagcgccagccgttgatcggcgccttgctcgaagacggtctggcacgcgctgcgcaagatgttgaagtggcaccgattgtggcgcgcatgcagttgctcaagggcaactccatcgacgtgatgctcaattgggagggtgagccgccgcaggtgatctacctggatccgatgtttccgcaccgtgagaaaactgccctggtgaagaaggaaatgcgcctgttccggccgctggtaggcgatgacccggatgcaccggcgctgctcgcggctgccctggccctggccagccaccgtgtggtagtcaagcgcccgcgcaaggcgccgtgcattgacgggccgaagccgagccatgcgctggatggcaagtccagccgttatgacatctatgctaaaaaagccctgaaaccctgaggccggccgctcccacgcagtcgcgtgggaacgatgggttcagggcctgaatgcgcgcataaacaacctcaccacctcctgcacatgctcttcggcctctacggcgctcagttgcccgccgcagccgtacagcaagcgaaaattcgccgtgcccttgagcaggcaaaagaagtgttcggctgccttgaacggtttatcgatgcgcagggcaccgctctggtcaatcttgccgagcaggcgctccatgccttgcagcatgcgcatggggccggcttcaaagaagatctgtgagagtttcacgtcctgattgccggtggtcatcatcaggcgatgcaggttcaccgactcctcgctgttgatcagccgatggaagccacgtgcgatgttcaacagcacagtctcgacgggcatgcctgcgggtagctcgaagtacatcaccggcaattgctcttcacacttggccaccaccgcggcagtgaacaacgtctctttgtcggtgaaatggctgtatacggtgagtttcgatacgccggccgccagggcgacggcatccatgctggtgttcgcgtaaccgttgctcaagaacagggacttcgccgcttcgaggattgcctggcgttttgccatgtccttgggacgcccggggctggcggtgttcacaggattgtcggacatttttacctttaatactggactggcgagtttggtattaataacataccggccagtataattattcctagctctatttgcgaaaggtccttcagcatgcgcagcgccgtcctgccccttgctttgcctgtcagtctggtcttcctgttggccgcctgcggccatgaagaagcgacccaaaccagcgtccgcccagccatggtggtacaaccgcaaccctcggcgcaggcaatggacagttaccctggcgaggtgcgtgcccgttatgagccagacctggcctttcgcatcggtggcaaagtcagcaagcgtctggtggaggagggggagcgggtcaaggccaaccagccgcttgccgaactcgacccccaagatgtgcgcctgcaactggaagccacccgtgcccaagtggctgccgccgaggccaacctgagcctggtgcgcgcagagcgtgatcgctacaagaccctgatggatcgtcagatggtcagccgttcgcagtacgacaattccgaaaacctctaccgagcgggtgaagcacgcctgaagcagatcaaggccgagcacgaagtctcgagcaaccaggccggctacgccgtgctgcgtgcgccccaggacggggtggtcgccaagcgtgcagtggaagtgggccaagtggtctccgctggccagacgctgttcaccctggccaccgatggcgagcgtgaggtattgatcagcctgcccgaacatggctttggccgtttcaagattggccaagcggtgtcggtggaattgtggagccagccggatcaacgcttcgccgggcgcattcgtgagctgtcacctgccgccgacccgaaatcacgcaccttcgccgctcgcgtggccttcacgggtggcaaagtacccgccgagctgggccaaagtgcccgtgtgttcatacaagctgacggtgtcattccactgtcggtgccgctgtctgccctcagcgccgagaatggcgcgtcctacgtctggcgcgtacagccggacaacacgcttgagcgcaccccggtgcgtattggcgctttcggtgaaaaaaccgtgccggtactggaaggcttgacccccaccgactgggtggttgccgcaggcgtgcatgtgctccatgagggccagcaagtgcgcccggtggatcgctctaaccgagtggtgaatctggcggccaaggagtagtcccatgggtttcaatctttccgaatgggcgttgcgtaatcgccagatcgtactgttcctgatgatcctgctggcggtggtcggcaccttgtcctacaccaagcttgggcaaagcgaagacccgccctttaccttcaaggccatggtgatcaagaccaactggcccggtgccacggcccaggaggtgtcgcgccaagtcaccgagcgcatcgagaaaaaactgatggagaccggtgagtacgagcgcatcgtgtccttctcgcgccccggtgaatcacaggtgaccttcatggctcgcgattcgatgccttcggcacggatccctgagctgtggtaccaggtgcgcaagaaaatcagcgacatccgccagaccttgccgcccgacatccagggaccatttttcaatgatgaattcggcaccactttcggcaacatctatgcgctgaccggcgacggctttgactatgccgtgctcaaggactacgccgaccgcatccagattcaactgcagcgggtgccggacgtaggcaaggttgagctgcttggcctgcaggacgagaagatctggatcgagctgtccaacctcaagctcgccaccctcgggttgccattggccgcggtacagcaggcgttgcaggagcaaaatgcggtctcgaccgccggtttctttgaaaccccgagcgagcgcgtgcagttgcgggtatcgggcaatttcaaaaccgtggaggaaatccgcaacttcccgatccgtgttggggatcgcaccttccgcatcggtgatgtggccgacatccaccgtggcttcaatgaccctccggcaccgcgcatgcgttatatgggcgcagacgccatcggcctggcggtggccatgcgtgacggtggggatattctggtgctgggtaaagcccttgaaggtgaattcgcacgcttgcagaagaaccttccagcaggcatggagctgcgcaaggtgtcagaccagccggccgcggtgaagaccagcgtcggcgaatttgtccaggtactcgccgaagcattggcgattgtattgctggtgagttttttctccctcggtgtgcgtaccggcatggtggttgccctggcgattccgctggtactggcgatgacctttgccagcatgtattacctcggcatcggcctgcacaagatttccctcggcgccctggtcctggccctgggcttgctggtggacgacgcgatcatcgctgtggaaatgatggcgatcaaaatggagcagggctacgaccgcctcaaggctgccagcttcgcctggaccagcaccgcgttccccatgctcaccggtacgttgatcacggcggcgggcttcctgccgattgccaccgcgcaatcgagcactggcgaatacactcgttcgatcttccaggtggtgaccatcgcgttgctggcctcctgggtggccgccgtggtgttcgtaccctatctgggggaaaaactcttgccggacctggcaaagattcatgcggccaagcatggcgccgatggtcctgatccctacggcacgcctttctaccagcgcgtaagacgtttggtggagtggtgcgtacgtcggcgtaagacggttatcgtcctgaccttgctgttgttcattggctcggttgcgttgttccgcttcgtgccgcaacagttcttcccggcgtccgggcgcctggagctgatggtcgatctgaaactggccgaaggcgcctccctgagcaacaccgccgaccaggtcaagcgcctggaggcgttgctcaaggaacacgccggcatcaataactacgtggcttatgtgggcaccggttcgccgcgcttttacctgcctttggaccagcaattgccggccgccagctttgcgcaattcgtggtgctggctaacaccatcgaggaacgtgaaagcctgcgcacctggctgatcgaaaccctcaacgagcaattccccgacctgcgctcgcgggtcacccgcctggagaacggcccgcccgtgggttacccggtgcaatttcgtgtgactggcgagcacatagaagaagtccgcgcactggcccgcaaagtggcggccaaggttcgcgaaaacgcccatgtggtcaacgtgcacctggattgggaagaaccgagcaaaatcgtctacctgaacatcgaccaggaccgtgcgcgtgccctcggcgtgagcaccgccaacctgtcgaaattcctgcaaagctccttgaccggttccagtgtcagccaataccgggaggacaatgagttgatcgagatcctcctgcgcggcactgtccatgaacgtaccgagttgtcgctgctgccaagcctggcggtgccgactgacaacggtagaagcgtggcgctgtcgcagatcgctaccctcgaatatggttttgaagagggcattatctggcaccgcaaccgcctgccgacagtgaccgtgcgcgccgatatctacggcaaggaacaaccggcgacattggtccagcagatcctgccgaccctcgcacaggtgcgtgccgaactgccggacggctacctgctggacgtgggcggcacagttgaagactccgctcgtgggcagaactcggtgaaggcgggcgtgccgctgtttattgtggtggtgctgacgttgctgatgctgcagttgcgcagcttctcacgcacggcgatggtcttccttaccgcgccgttggggttgattggcgtcacgctgtttctgctggtattccgacaacccttcggtttcgtcgccatgctcggcaccatcgccttgtcggggatgatcatgcgcaactcggtgatcctggtcgaccagatcgagcaggacatcaaggccggcctggcgccttggcaggcgatcatcgaagccactgtccggcgttttcgccccattgtgctgacggccctggcggccgtgctggcgatgattccgctgtcgcgtagcgtgttcttcgggccgatggccgtagcgatcatgggcggattgattgtagcgacggcgttgactctgctgttcttgccggcgctgtacgcggcatggttcagaatcaggaaggatggggtgtaaacctgcgaatgttttggtaagccgggcgggaacctttttttcacgcttgccacatatggttacctgttcgacaggtatttaatccggtcgattttttatcgccaggatcaagtttccagaacattcatagaggtggaactgagatgctactacaagcattgggtaacttttataccgggatcggcatgctgctgggtggtggtctaaaccagatgggctgcaacaagcattcggataatgattctgtcagtcggcgtgagctgactgatgcgctcgaatcctttaaatacgacaattcacagcccaagggcaatatcacaatcaacaacagcattgccaacgccaatgccaatagcaacacccaattgggacgctcaatgcattgagtgagcgtttgtcacttttttatcattggatgaacggcaagcactttgcgcctcgcgaagtgtttgccgtttacgatcaagcaatgctccatgggccaggctgttggctggttatccgcgccgatttacatgctgatgcaaacacccagcagctcagttggaacgcctgcgcctgtttccccgactcagaaatgcctgatggacaggcagaagacttggcatcgccatctggcggccaagccgttttcaatgagtatatggagagttctacatgtcgttttttaatgccattgcagctttcaaaggggcgtttctcggggctttgctaggtaatcattttccccgtgatgatgttggcaccacccgaccctacaggcctgatgaaggggcttcgggccatcaccgtccccacttcagccacacccgccccgtgacgacataccagcatcaacaaccggtcagcggctatcactcgccccacagacccttgtacccgctttttcgttgatccattagtgggcgttgcctgaaacaactgcgccaaggccgttagaagcggccttggcgcagtggtaaacaggtgcagttgagggttacagcgccccaaacacctttttcgccagactggtggctgcagcggccggattcttgcgaatggtctcttcccgttgcgcaatcatcttgaacaacccgtccagtgcctgctcggtcacgtagttttcgacgttggcgctcttggcatccacggcaccgaaagctgcggccttgccggccagggcgttgtactgttgggcgactccgactttgtcggtggcggccttgacgatgggcaggaacttggcgcggatttcctcgcggctgcttttgtccaggtattgagtggcggagtcctgaccaccactgagaatgcccttggcgtcggtcacactcatcttcttcacggcgttgaccagaatcggctgggcctgggtcacggcggtttcagccgccgcgttcatgctggtttccagctgcgtgacctggtcacccatgccaaacattttcagcttgtcggcgactttgccgagtttgcccggcagaccgattttcacttccgggttgtcgctgaaaccaccgggtttacccagttgcttcacggcgatctgcgcaccctgagtcaaggcatccttgaggccaccgctggcgtcgccctgggacaggctactgaggtccagggccatggcattggcaccgaacatcagtccggcgcacagggcggtaaggccaagagttttacgaaacatgggcgcttccttatgacgtggaaattattaatgtgcgaccgcatcaacccgcaggcgcagcggttggggatcctggccattgaggtgcacggcgtgccgctcggtggtgataaacagtagcttgccgtccagctcgatgcgagcgctcaccgagtaggtgtggccaggcttgacctgggccgggtcatagctcaggtgaaacggcagcggcacctgacctttgaccgggcctttctgttcggcaagggtcacggccggagcgtccatcagggacacgtcttgcaggctgacgctcagtgtggcggcaggcggcagggcaatgcgttgcaggtagaacacttcgccgtcgaggctggccttcggggttggggtcatcgagtggcaggctccgagcagggctgtcaggccaaggaggatgatctttttcatggtgctgctccttttcaacggcgccggaatccgcccggcgcctcagtcaatctagcggctttctttagggggcaccgcatccgcttcggccgatgcctcggcggcgccatccacgcggtgcaaggcgacctggcggatcgacaggcgaatatcggccggcagcacgcgtttggccgcgccttcggccagttcgccaagcaggtcgtgatagcccagtttgccagcttcatcgcggcgcagcacatcttgctccagcaacgtctggatgaaatgtcggaaaagactcttgtcgaagaattccggggcgttgaggccgtgcaggatcgacaggcgctgggccatgatcgtgcacaggtcttccaactcttcggcgctgatactgttctggccactgttgagcagcagcgagatcgccatgtagaagcgctgcagggtctgggcgatgctcttggacagtagcgtcagcagcacaaactgccgcgaactcggggccgggcgcaggtacacgttgttttcgaagcgcagcaggccttgttcgacgaacgcgtccagccattggtcgaccacggtgtccaactcttccagcgaccagcgaataaacagctccgattgcaggtacgggtagagcgcgcgggtgtagcgcaggatctgttcgcggctcatccgcgagctgctctggaagaagctcgcaagcaacgccggcagggcaaaaatgtgcagcacgttgttgcggtagtaggtcatcaggacggcgttctgttcgtccaggtagacgatcttgcccagggcgtcgctctgttccgacagcagcttcatgtccttgacgtgcttgatcagcgccaggccatcgccttccggcagggtggtatggggcgagtagggcacgcggcgcaacagcgccaggtacaggtccaactgacgcgccatggcttgctcatccagggccaggcgtgtggtcgacagcagtgccagggccaccaggttcaccgggttgatcgctgcagcttcgttcaagtgccgcgccacctgctcgccgaggcggttggtggtttcgttgagccaggccggcttgtagttcgggcccagttcctgggcgcgccaatccggttgttctgcgtcgaggaattcggccagcttgatcggttcgccgaagttgacggcgacttggccaaagcgctgcttgagggcgccgaccactttgaaaatatcgaagatcgattctttcttcttgctcgcgccgcgcagttcgcccaggtaggtgcggccttcgagcacgcgttcatagccgatatacaccggtacgaacacgattggcatgcgcgaggagcgcaggaagctgcgcagggtaatcgccagcatcccggttttcggttgcagcatgcgcccggtgcgcgaacggccgccttcgacgaaatactccaccgggaaacccttggtgaacagggtgtgcaggtattcattgaacaccgaggtgtacagcgggttgcccttgaaggtgcggcgcatgaaaaacgccccgccacggcgcagcaggctgccgatcaccggcatgttgaggttgatcccggcggcgatgtgcggtggggtcaggccattcttgaacagcaggtaagacagcagcaggtagtcgatatggctgcggtggcaaggtacgtagatcacctcgtagccttgggcgaccttctgcacgccctcgatgttgttgaccttgatgccgtcgtagatcttgttccagaaccagctcagtaccacttccaggaagcggatcgcggtgtaggtgtagtccgaggcaatctcgttgccatagcgcagggcctggaccttggctttttccgggctgatcttctcccgttcagcctcatccaggatggcctggcggaccagcggcatattgaccaggcccttcaccaggttacgccggtgggacaagtctgggccgatcaccgcagtcttcaggttacgaaagtgcacacgcaggatgcgctgggccatgcgcacggtacgttcgtgccctttattgtgctcgatcaattcccgcaggttgataggcgcggagaattgcacccgggtcttgcgccccaggatcaggatgctcaacaaccggcgcaggcgcccggtgacggcccagctgtcggcgaacagcaatttccatgggctggactcgctctccggggattgtccccagaacacgctgaccggaatgatttgtgcattctcttcggcgtgctcggcgagggtgttgaccaggcgcgtcagggtgggcggtgcgccgcgcttgtcctggcggccgagccagtccggatccggggtgaggtagaaaaacgctgcgggctccagcaacggccccactgagactggcagcaccgggcgcggcaagccggccttggtgcactcggtatcgaccacagccaattcggtgagggagggtgattgcaggacgtagaaaaccggccggctgcggtccaggttaagggttagggacgactggttgatcgtctccgagcgaacccagaggtacaacagtcggcgcaaggtgccaaacaccagacggcggaacggggagcgggtcataggcgaactgcttcaagtggaaaaaaccgagcaggcgctcgggcgggtagtgtgccgtattcgccaaaaatcggcaaaaaagcagcgatgtaaacttgagttgatggtttttgagcctgtcttatactcggcagttcaatgcaccgactcaacaataaaaaccaagtgggagtgaactgatggcaacgcgcgaaaccggcaatgtgaagtggttcaacgatgcaaaaggctacggctttattcaacgggaagatggcaaggatgtttttgtgcactaccgcgccattcgcggtgaaggccaccgttcgttggccgaaggccagcaggtggagtatgccgtggtgacgggtgagaagggcttgcaggccgaggatgtggtcggtttgtaagttcaccactgaaccaatgtgggagggggcttgctccagatggcagagtatcagtcaatgtattcagtgactgacccaccgctatcgggagcaagccccctcccacacttttgattgggtttacagatcaggatcaggtggttttccaggtgatctgttcttcaccgtctacgctgatgcgaatccaggtatcggcactttcctcaccttcctcctcaacccacgtccccggtgcacagcgcacttcaacgttcagcgcggcgaacgcagcgcgggcgcaggcgatgtcgtcttcccacggggtctggtcgctttccaggtacaggctgttccacttgccgacggctttcggcagccaggtgaccggcacgctgccggccttgcacttgtaggtctggcctttctggacccagtcggtgcacgggcccagggcgccgccgagccaggcggcgatggccttgtgatcgacgtcggcgtctttcaggtaaatctcaatatcaggttggcgcatggatgttcctcgttgcgggattcgaaaatccattcgcggatgcttgaaaggcggttattgaagcacgaaataatcgtagcgcatcgacacagtgaccagcagtggctcaaccgcctcgatcacctcgctgcgacgctcggcactggcacgccagccgtggggcgtcatcgccagcaggttggcgcggtccttgggggcggccaggctcaggctgaactccagggtttcactgtgcgcaaggctcatgccgtccggcaccagggccaggtgtttgtcgtcggtgtactcgcgcacttcgtcgtacaggcgctcgcgcagttccatcaagtggccgctggtggggccgaccttcatcaagccgccaccggggctgagcaggcgcttggcctcttgccagtccaaggggctgaacacactggcgaggaactggcagctggcatcggccaatggaacacgggccatgctggcgatcaaccaagtcaggtctgggttgcgtttgcacgcacgcttgaccgcttccttggagatatccagggcatagccatcggcgttgggcagggcctcggcgatttgcgcggtgtagtaaccctcgccacagccgatgtcgacccagcgctgcggtgcgcgctcgtcggccagctcggccaggcgcttggccaccggggcgtagtgcccggcgttgaggaagtcacggcgtgcctcgaccatggccaggttgtcgcccgggtcgcggctgttcttgtgctgcaccggcaacaggttcaggtaaccctggcgcgcgcgatcgaaacggtgcccggccgggcaggccacgccattgtccactgcgttgagcggtgcgctgcaaatggggcaggcaagcatcaggcgagcaacttgatcagggtctggtaatagatttcggtcagtacatccagatcgctggcgagaatgcgctcgttgacctggtggattgtcgcgttgaccgggcccagttcgaccacttgggtacccagggtggcaataaagcgcccatcggaggtaccgccgctggtggacgccttggtctcgcgcccggtgatcgccttgatgctggcggataccgcatccaacagagcccccggctcggtgaggaacggcaggcccgacagcgcccagtccacatgccagtccaggccatgcttatccaggatcgccgcaacccgttgttgcaggccctcgacggtggactcggtggagaagcggaagttgaacaccgctgtcaggtcaccggggatcacgttggtggcgccggtgccggagttgagattggaaatctggaagctggtcggcgggaagaaggtgttgccgtcatcccagtgctcggcagcgagttccgccagggccggcgcggcgaggtggatcgggttcttcgccaggtgcgggtaggccacgtggccctgtacaccgcgtacggtcagggtggcgccgagggagccgcgacggccattcttgaccacgtcgcccaccagggtggtgctcgacggttcgccgacgatgcaccagtccaggcgctccttgcgtgccgccaggcgttcgatcacagccttggtgccgtggtgcgccggaccttcttcatcgctggtgatcaggaaggccaccgaacccttgtggtccgggtagtcggtgacgaagcgttccgccgccaccagcatcgccgccaggctgcctttcatgtccgccgcgccacgcccgcagagcatgccattttcatcgatcaacgcatcgaacgggtcgttctgccaggcctgcaccgggccggtcggtactacgtcggtgtgaccggcgaagcacaacaccgggccctcatgcttgccgtgggtggcccagaagttgtccacgtcgaagatgcgcatcggttcaagtgcaaaaccggcgtcgcccaggcgctgcatcatcagcttctggcaatcggcatcgaccggcgtgaccgatgggcgacggatcaggtcgatggcaagttgaagggtcggcgaaaggtcggcatgggccgtcatggtgaaactccggaaagcgtatttggaagagcggggcgggcacacaaaagggccgttatcttatagcaaaacggcggccagaggccgccgtttagtgcattgcgcaagtttttacaccgcagtcacaggctcagccttcgatgccggcttgggcagcgacgacaggaacgccatgatcagcgccgccacgtacggcagcgattgcaccagcagcatcaccacccagaagcgtatgtcattgctgggcaggccctgtaccaggtagatccccagcgctgcgccccacagcagtagcatgatgaacatttcttcgcgggcttcggagatcgccacccagaagccgtggttatccgcgtttttcggcgtacgaaagaacggaatactggtggtgaagaagccatacaacactgccttggcgatggtatgggacaacgccaacccggccagcgccgcgcagaacgcatctttcaagttcacgcctaccgcacgacggtagaggaagatgatcttgccgaccttgaacacaaacaacgccaagggcgggatggcgaaaatcagcaacggcgggtcgacccgcgtcggcacgatgatcattgccgccgaccacaacagcgcgccgacggtaaagaagatgttcatgccatcggccacccacggcagccagccggcgaggaagtggtagcgctggccgcgggtcagctcggtgcccttgccgcgcaacaggctggcggtatgacgcttgatgatctggatcgcaccataggcccagcggaaacgctgtttcttgaagtcgataaaggtatccggcatcaggcccttgccgtagctgtcgtggtaataggccgctgacaggcctttctcgaacacgcgcaggcccagttcggcgtcttcacagatgcaccagtcggcccagcccagctcttcgagcaccgaacggcgagtcatggtcatggtgccgtgctggataatcgcgtcgcggtcgttgcgggtgaccatgccgatatggaagaagcccttgtattcggcatagcagagcttcttgaaggtgctttcgttctggtcgcggtaatcctggggcgactgcaccacagcgatttttgggtcggcgaagtgcggcaccatgtgcttgagccagttgggcgacacgcagtagtccgagtcgatcaccgcgatcacttcggcgtccttggcggtgtgcgggatcaggtagttcagcgcgccacccttgaaaccagccagaggggcgacgtggaagaacttgaagcgcgggcccagggtttcgcagtagtcacgcaccggctcccacaccgcggggttcttggtgttgttgtcgatgatcaggacttcgtagtccggataatcgagggcggccagggcgtcgagggtctgtttgaccatctccggcggctcgttgtagcacggcacatggatcgacactttcgggcggtagtgcgaatccccgatcaccggcaggaattcacgccgacgcttgtgggtccacactgcttctgccagttcgtgggcttcggtcagcaacacgataaacacaccgagggcgcccagagcgaggaggatgcccacggtgacgctgaaccaggtgctgtattgctggctgtagtcgtagccgatccagaccagcaccgacccacacaggaacgcgataaaggtcaggaaggtacgaccacgctggcgcagggccgaaccgtcgatcatcaacagggtcagggacagcagtgcaagcaccaccgagccgatggccagcacgcgccattgcgggattgctaccaccgggccttcaaaattgaatttctgctggcgtgcggcgttgaacacgccccagtaggcgcccgccgaaccttcgtcgctgaccttccaaggctggtcaaaggcttcgattacgaagtagttgtaaccctggcgattgagcttgttcaccagcgtgcgcaggtaaatcgcctggtcggccggggacgattcattgccaccgcgcatacggccgttgctcggccagccaacttccgacagcagcagcggttttttcgggaaggctttcttcaggtctttggcgcggtcgatcacgtattggccggccttgtccatcgggatgtattcccagaatggcaggatgtgcgcggcaatcaggtcaacgtgcttggccagttgcgggttcttttcccagatgtgccattgctcggaggtggtcactggcactttcacggcggcgcgtacgcggtcgagcagtacgatcaggtcttcgggggtaatttctttacggaacaacgcttcgttgccgaccaccacgcgcacaacactgcgcgaggtgttggcgatttcgatggcgcgctggatttcacgctcgttgcgttcaagatccgggctgatccagatccccagggtcacgcgcagaccgaactcttcggccagcttggggatgtcacccagggtaccgtcgaccgagtaggtacggatgttgtccgtcagcttgctcatgatcgccaggtcttgacgcatctgttcgtcagtggggaactggttcttctgcgggtactggccctgctggaacggcgagtaggaaaacccggagatctgttcaggccagttgggggtagtgaccgggcggttgatcagcgcccagaagccggtgaacagcgcggcaattgccagcactaccaccaggttgagtccaaatttacgcgatgacatggcgatttcgggttccaaaaggtgtggaacgaaaagaggtgtcggcctacgccgaacggcgcgcatcctacaccggcccctccctgagcgtatagcagacaaggaaaagccggacgttagtctgcgaaagttcacctaagttctttacttgtagctggaagcttcgaacttgtcgctctgtagtccataatgcgcgccggtttttggggtaatgatcatgagtacagaagatccgcggtttgcaggcgtcgcccgcttgtacggcattgagggcctggaacgcttgaaagcggcccatgtggcaattgtcggcgtcggcggcgtaggctcctgggcggcggaagcgattgcccgttgcggggtgggcgagatttcactgtttgacttggacgacgtctgtgtcagcaatagcaaccggcagctgcatgccctggacagcaccgtgggcaagcccaaggtcgaggtaatggccgagcgcctgcgaggcatcaacccggattgcagcgtgcatgccgtggcggatttcgtcactcgcgacaccatggccgagtacatcaccccgaacatcgactgcgtgatcgactgcatcgacgccgtcaacgccaaggcggcgctgatcgcctggtgcaagcgccgcaagatccagatcattaccaccggcggcgccggcgggcagattgacccgacattgatccaggtgtgcgacctgaaccgtacctttaatgaccccctggcctcgaaagtgcgctctaccttgcgccgcgactatggcttttcgcgcacggtgacccgtcattacagcgtgccctgcgtgttttccaccgagcagctgcgctatcccaagccggatggcagcatctgtttgcagaagagttttgtcggtgatggggtcaagcttgactgcgcaggagggtttggcgcggtgatgatggtgaccgccacgttcggcatggtggcggcgaccaaggcggtggacaagatcgtggcaggagtgcgcagaccttcggaacgggtcaagcccacctagatcccactgtcgaacatagatccaaatgtgggaagggcggtgcgacgattcgacttgctcccgattacggtgtgtcagattgatatatgtacctgatccaccgctatcgggagcaagccccctccccagatttagttgtgtgtacggcttaattcacgcatgcgctgcaacacggcattcaggccattgctgcgcgacggtgaaagctggcgggaaagcccaagttgattgaaccaaccaggcaaatcaaccgcctgcaactgcgccgccgacaacccattgacccgcgccagcagcaacgccactaacccacgaatcattcgcgcctcgctgctggcagcaaactgccaatggccgtcctgcaagcgccccaccagccataccaggctttcgcagccatgcaccaggttggcttcaaccttttcgtcatcagccagtacgggtagccgctcgccccattgcatcagcatacgggcccgttgctcccagctgccgacggcctggaacgcttcgagtgccgctgctgcgtcaactggcaagttcatcgcaacatgtccagtgcctggtccagcgcttcaaacaagcgctccaggtcgtcggaatcgttgtagagcgccagggagacgcgaatggcccccgacaactgcatcgccttgagcaacggcatggcgcaatgatgaccggcgcgcacggcaatgccttgctcggtcagaaggtgagcgaggtcggcattgtgcacaccgtccaccacaaagctgaccaacgccacttgcggcgatccgagtacgcgtacgcccttgcgtgctttaagcccacgcaacaggtagtcgtgcaacgccgcttcatgggcgataacggcgggctgatccagggaactcaggtaatcgagggtcgcccccaggccgatcacgctggcaatcggcggcgtgccagcctcgaaccccaagggcgcgggacggaaactggcgctctggtaatccgcctgttgcaccatctcgccgccgaattgccaatgacgcaggtgatgcagggcttcattgcggccaaatagcacgcctacgccgtcggggccgtagagtttgtggctggaaaatacatagaagtcgcagcccaaggcctgcacatcatggcggccatggacgatgccttgggcgccatccaccacggtcaaggcgccgtttgctttggccatcgccagtaaggcctccaacggctgccaggcgccgagtacgttggataactggcttacggcgagcaggcgcgtgcgcgggccgatcaagtcggcggcggccgcaagatcgatcaccccgtcatcacccaggggcattaccaccagtgtgagcgcgcgacgcttggccagttgctgccagggcaacaggttggcgtggtgttcgagggcgctgatgacaatctcatcgcccgcattgaataagtgctccaggccgtaggccaggaggttcagcgcagaggtcgcgccgtgggtaaacacgatctgcccgctgtcacctgcgttcaaccactgtgcgaccttgcttcgactgtcttcaaaggcctgggtcgcatgggctcctggcaaatgttgggcgcggtgcacattggcggcgccattggcgtagtaatggctgatcgcatccaacagggcctggggcttttgcgtggtggcggcgttgtccagataggtctggtcttgccgttgcagggtggcgatggccgggaaatcggcgcgccagggggagggcacaagcatggtgatcaagactcgtataagcgggccgccccggaggtgcggcccgctagtggcatcgagtggctgcttagttgtgagcgtgcagcgcttcgttcagttcgatggccgatttgtgggttttgcattccacggcaccggtcacggagttgcggcggaacagcaggtctggttgaccagccagttcgcgcgccttgaccaccttgaccaattggttctgctcgtccagcagggcaaccttggtgccggcggtgatgtacaggcccgactccaaggtgttgcgatcgcccaacgggatgccggtaccggcattggcgccgatcaggcagccttcgccgaccttgatcacgatattgccgccgcccgacagggtgcccatggtggagcagccaccgcccaggtccgagcctttgccaacgaatacgcctgccgatacgcggccttcgatcatacccgggccttcggtgccggcgttgaagttgacgaagccttcgtgcatcacggtggtgccttcgcccacgtaggcgcccaggcgaatacgtgctgcgtcagcgatacgcacgccagccggtaccacgtagtcggtcattttcgggaacttgtccaccgagaacacttccagcagctcgccacgcaggcgcgcttcgagttggcgttcggccagttcgttgatgtcgatggcgccctggctggtccaggccacgttcggcaactgcgggaacacgccggccaggttcaggccgtggggcttgaccaggcgatgggacagcaggtgcagcttgaggtaggcctcaggcgtggaggtcagcgcggcgtcttcggccagcagtgtggcaaccagtggggtgtggctttcagccaggcggtttagcagcgcggcttgggtggcgtcgacgttcttgagtgcatcggccagttgcagcgcctggctgatggtgaacgtgatcgcctggttaccctcggtgtaacccaggatcggcgcaatggccgcaacgatttctgccgacgggttgagcaacggttgtgcgtaaaacacttccagccaagcaccttggcggttctgagtgccgacgccgaagcccaggctgaacagggaattggacatgctgttacctctacaaaaatggaaggctggcctacttgagggccgccgaataactttctggcttgaagccaatcagggttctgtcaccgagatcgagcaccgggcgcttgatcatcgagggttgtgcgagcatcaattcaattgctttcgactgatcgagatcggctttgcgttcgtcttcgagtttgcgaaaggtggtgcccgcacggttcaaaaccacctgccaaccgtgctcgttgcaccattgggtcaagtgttcgcggtcgataccggccgttttgtagtcatggaactcgtagctcaccgcgtgctcatcgagccaggtgcgcgcctttttcatggtgtcgcaggctttgatgccgtaaagctgtaagtgcttgatttcattgggcataaaatcctccccaaaacttccccaatatcgcccaaaaattcagccgtcgattatgccacgtcgatccactcggcgcctcggctgtcgcggtacagatcggtcattgtggccgaacggtgaccgagtagtttctgggcgtcacggccttcaagctcatgaaggcgtgcagccagcgagcgctgttcgtgaaaggacggtggctggcgcccaaaacttatacccagcttcgcgccggccttgtcgcgcgcttcggcaaatgcagagctcagcgtgtccagcaccaatggctggccagcctttgcgcggcccgaagcttgtgcatggtgcaccaggtgttgtgacagaacgcggtcgcggcattgcttaattacggtggacagatccaggccgaccgactcgaggcgaagcgcggtgctgatccgcagcctggccccggtcttggactgaacgacatgaaggaagccgtcgtgcacgtccttgaaaagcatcgaggctatatcgtcccggcgctggccagtcagcaccgccagttccattgccctgcgaagccatggtttcttggcttcctcatagattgccttccacagttcgagcgtcagccgttcgcgcttgatgctcacccgcgcggccttggtcacttcgaccgggttggcgtctgcccaccctcgcgcctgagcctcggcgaacacgtctcgcaacagcgagcgcatcgccctggccatctgcgccttgccctctttggccatatccgtcaggtaatcggccacatccatcgtcgtgatgtccttaatccccttagagccgaatacagctgccagccggtttatccgcatacccacattcttgttgctgctggcggacagctttcgttcggcgaacagctctcggtactcttccagccattccgagaacaatttgccaggtgcaggcgccggggtgctgatgcgctcggcaagcgttggtttgattgcgtccgcgtgattggctgcgacggcctcgcgaatcgccgcctccttgtccttgcccaggccgaacacgcgaccactgattgggtcgcggtaggtgtagtaagtgacgccgttgcgggtgtcggtcttgcggtagagattgggcggaagatcctttgacccggtgttacgcggcctgggcgccattgcgtgctctctctattctgctgatcaggctaccgccgacaatccgcaccggctgctgatcaggttcttggtagtgggcgtcggcctctacatagtagttgcgcccgtgctttaccggtagcggtgctatccggccctctcgcgcccatttacgcagggtgtttgggcttggcggcgtcttgaactcggcagccgcccactcgtccagggtaaccttgctcattgagccctcctgccgcccaccgtgggccgcgctttcttgatgatgtggattgccaagccgaagctgatcagcagccaggcgcatgtgccggcgaaggcgtagagcagtgcctcggtggtgcccgtgccgacaaggccgggcccggcccagaagaaccagccgagtgttcctaccaggtacagaaaagcgcccagcagtatcagggtgagtttcatagcgaacatggggtgtccttgccgcgctgggcggcagaaggtgggaggggttattcgtcgtcggagtcaggatcttcatcatcgccatggctgacgctgatgggcagtttgccaaggcgatccattgccaggacgagtccgatgcgcaaaccctttgccatatcttttgtcagcatgatctcgactggatcatcgatgcccagggagagggtcgtgccttctttggagttgtcggtaatgatctgcagttgatcggtctggcgtttatgccaggcaagcagcgcttcgatcatctcgccgacatcctgcggggcgtgtactgagccctccagcgcgcttttgacgagattcttaagctccaccttttcatcttcggcgcgctcaagctggtcgtcggcggcgaatggcccgcccaccatcgaccagctgctggcgaatacctgggcttgctccatgatggctttaacagttttctcaggcatgcgaattcctcgcccgtcgttcaccggcaggcttgatgggttgataaaaaacgagaggccaaacgcttcttaacttgtaagatatgtttaggaatttattgaggtttgaaggaatggcggtctcagaaggggtgcgtgtttcaataatagctggcttggcggcggttgttggggggttggtaggtgctggaatatcaggatatttcgcagtcaccgcagttaaagaaactgcaaggtcacagaattcgttagcgcttgcacaaactaataaggagaagtccgtaccgtttttttctgcattgcgcgtaatgaacagagttgcgttaatctcgggcgctactttaaaagattttgaggctgcttgggtcggcctcgactccgctgcaggaatgcttgagccatatttagattatggacaggcaatgaagatggaaaaaatagttcgcggttataggtcgttttttgatctcgaagaaccggagttgcgcgataaggctagaattgagttggtaagcgatatctctgagtttatgttggagtttcatgtttcaaatgagcgtcttgcttttaatgctcaagcatctcctgaagagttaatcgaagatcagaagattaataagtcgctccttcaaaagcagttcaatggagagctaaaatttcaaactgaagatgataaatcaagtagtaactagtagttcgtcacggcagctccttcgccgctatagcggctaactttgaagggggaggggttacaggttttgcgggtggagtacggatgtactcttcgcgggatttcagtcatcggtgccggtgtaggtgcgccatggcaccttcacgccgttgaccagaaagccccagtcaccgcgccacttgctggtgatgaacagggtgaagacgccgccgggggatacctggtcgatgcggtggtattcaccgtggttgaggcgggcggtgtcgcccggactgcgagtcttcattgacagcttgcatagatcgtcatgctcttccctccacagtaaagggcggcctggggtcagcatgtcaaaagggtttgcaggctccaaccgttcctcggtgtaccaaccgcgcaggatgatggtgcgggcgttccagggatggtcatgcagatcccgatcttcgtccgggcgcatgatgtggtgcacgcggaacgaccacgggcaccaccacagcgccggcttgtgcgtgtcgcgggagtaggggttgaacagccaccagcggcccatgtacatctcgttgccgtcggcggacatgatgtgcaggtacggggtgcgctgggcacgggtgatgagccaggcggcaaccgtcggcttcgcaagcagcttggcgacaacgcgccagaacaggttgatcatggggagtccttgccgggccatgcccgggcggtgtggtgctacgatggccccttcctctaaatgggctggaccatgacaaagcacgatatttacgatgagatcgaaggctttcaggtttggaactacatggagtgcgacaaggacgatgagggccgggagacctggcgtatcaacgtcgaggtgaagcgcggtagtgaagtggtggtgccggttgttgcgggtgatcgaacctatgttgaccgtggcctggcgcaggtagctgggcgtgaagtcggagcccgattgattgctggggcaggcctataggttttctgcaggtatggtgagctccggtctggccatcccccggtggttgaggggagggggatcaggcgattgcggatagcgcgaggatatcctcgccaccgcgcgcgatgccggcgtgcagctccaccttgctcccggcgagcatcccggcgatctgggcgtttagatccagctctaccgccttgcctttcctagacttcccgatttcctgggtagcgagatattcgctgatcagtgccttgtcctgcgcctgaatcgcgacgaggtcttggccggtggcggggctccccaccggatcatcgtcgtcttgaggcacaagagctttcagcttcgactggacctcccaaacccacgccagcgcaaagtgatcaccggcagtttctgccgaataccggctacgatggactcccgccctgactgccgagcagtactccttgcgtgcctgagtaagcttggtgtgcagtgcttcatacgcgtacagggcgatgttctgggcgggagatacgccgacgaatgtcgcgcactcaatgatttggacttttgcggaacaccacgtccggcgccgcagggttgtgcagctgaatgcttctgctacggcgatgctcagctgttgatcccatgccggtcgacgcttggcgcggaatagggacgactcgacttcaccgacgtcgctcaacttcacatccatctcagtcagccggtactcgcgcatcaatgcctgggcctgccggagcgcggtggcggcttcgttctcgttggcgctttgagccagtgccaggcaatgcttgatcttgcggattgcgcgctcgagcttcttttcgtcaatctgttgtgcggacatagaggatcctcgccgagtatattcagcaaattccaaaaggagggtgtgggagatggatctgtggaaaagcgtgagccgatgcttaccagctagcttggtttttaagattgccctgcgccgatgccgcagggctgaggagcagctacacaaaacggcgccgcctaacactagagcggcagagagtagcggggcaatctacgaatacatgcgggaaagtttggacctgtttcaagagcggcgctctttgatctcaaataactaccgcaggatggctgacgttctaaacgttccaatgcctgattttgaagacgagaaaatgtgggaacgcatcgaaaacgactacaccggacgtacatctagaacactaaccgtcgcgggtgaactcgccactattgcgattattcgagaagcgcaaaaacacagacgggaggttcgtgcattttggctaacctggtttacgagcttgggtggcattctcatcggtattatttcggtttggaaaaagtagagactctcatcaatccccgcagtagaagtcaatggactcgtcgtgttcggagaacatatcaatttggatatcggagtagtcgagcatctgctggtagctggggcggtcgctgcgaaagcgatcgccgtagccggtgaatttgccgccggacaccactgagctttccatgcgtgcccaccattcggctttgggccggtcgctggcgatgatcgaatacacctgcttggcgcccttcagaaagcaaaggtcgcagttaccttccagcgttctgccgtggatcgtgggtagcatcaggtcgaatgactggccggcccagaagtcggtcacgttctgcacgccgacaccggcgtcagcaagcggcattaccatggttgcccacttgctttcgctggtgcttttgcggtgccggatcttcacgactcggcgcggttcgtcggcacggatgccagtcatcatgtcgaccggcacctcctcggtagataggcccaggctacgcagatacttgtggatgatccggatcttgaggtcgatggtgcagaaccgcgtcaccgggttgggcagatacttgcgcttgcggattagggcttcgaacggttcgccctggcggctggcggtggcgtaatccactaccgcaaaccctgtgtcatcgtcgcgaaactccagccagacaatcggcactgcccagcgcttggcgcattcctggacgaactccagggtggccgggtgttccttcccggtattggcgaatgtaacgaccagatcgctcaggtcttcgttgctgtccagcacctggcgcagcatgtaggcgctggtgcggccgccggagaagctgacgaccgttgtcccggacaatttgtagggagacataggggatcctcgccggctggcgtgattcgttgatatggggtattacgggtgaccggcatggagccggatcgaggagattcttatggccgaagaactaaactttgcagcgtggcttcgtagtggcgacattcagacatctatccgaaagtgccaggagctttttaattccggagttttttcatctgccggaatttcaaacccattatttgagcccgctgttgttacgctgctgataaatttgaacgaccttttggggaagtccaacaaggacgaaatgcgggtggccgttaccgatcatgtcgaactatctgacaagataaaggatgtgaccgatctgatcagggaatgcagaaacgcggcttgccatattggtagcggtgaacatttgttcgaggggatcggcaagttcacatttaatgtgatctcaggcttatcccctaatgcattccacctgaatggcatcaatctcggatgcgattttgcagacgacatagccgtttactatggagagaaacgtgtttatttaaggcggcatttacttcttgcgcttgaggccgtttcgaaaaactatccaccagcgcattagttcgatgagtcaggcgcgcctaactttgaagtggagcatcgctttgatgctgtggcagtaatcctgaagccgctcataggccttgtatctcgcctggctgcgagtggcggcccagaccctgaccagatcttcgcgggcttcccggctccagtcgagatcgtcccagtcgtgcctgaacggtaggaccaaccactctttcagcggcagcgtctcggccatttcgccgtactgcatttcgtgagttgggtggtagtttccgatgcgcttcttcgggtcctcatccagcaccacgccgatgtagtggccgcgatctgccaggatgacaccgggcttcccgtaggcaatgacgcggcggccgatttcggctggcacctgatagtgctgccggacgtacgcgcagttgtgggtcatggattatctccagtcaggcgccgccctccaattccgggtgcgacattagtggtggtggcgtcgcgtgtgtggcaaagtgcggcatttagttaaagcgaatgcgaggtgaagtttggaggaattagcgaaggaatcgagctcgcttcattacacagctccaatgctgacctcatacaatcaaaaaacaggtgtttttcagaatgttttgacgccagagccaattttaataaaagttgactctggtacggatcccggtgttctcctgattggtattggcggtatattgtcatcccttgtaattgcgatatttacgtacaggattcaaaggaatcaaataaaatcaaacgttgcccaacttcgacaccactggcgcaatgaacttcgagattgctcgagtgagtttttacaaaaaatctcttcggtagcgactggagtagtaatgagtgaagattttattgagactagtgagcggtctgatttgctatcatccgcacttaggttgcaaataaaaatgaatttgctgatctctaaggatggcgcgctggagcgcggtatttctgaaataagtcaggacgtattaataggtgtcagggggctggagtacggtgagtctccagagccaatattcaagtctatggtccaattggaggacatggtgaaaagccaactagataaagcatggggccatattcaagatgatttgggtgtaaataagaaattttgggggtttttaagtcgaactcaacggaaaccaaaaagtccggaacagacatgagtttgtatctgcaattctgttcaaggtctcgatggttagcaatcggcacgcaggtcattgcgaccacccttcgatattgatttttttgccatcggcgcgggcttccagtacctgggcgcggttgatcgctgccttccaagtgaagcacatgcccatgaccatgccggtggcacgctctattacgtgataggcgccccggcccttattgactacctggaagcgaacctcttgcacgggctgctctttgcctatcaaggcgtacatcgctctagtggcaatgcttgcacgggtacggagggctgcgagcccttcggtacactcttgaattgataggggcatatcttttccctcggttgaagttaggcgagcagcatcggttgttcggtgcggcgcaccatcctgacctctgctgtacggcgttctggcacccggcgatcacggcgcattgcgtcgtcaccgatcattgcgtgcatggcgatcaggctggccaggacgaagcacatgggcgagatgatctgccgacgcatggcctcggccaccatcgcggtctggcgggtcacgccgagcttgaacatggcgcaggaaagacgcttggccacggtgcaggccgccacgtcgaactggcgcgctatctcttttgctgtcatgccctgggcagtgccgagcaggtactgaacttcctttggcgcaaggccgcgtccgagatgacccttccatgcgccgctgacgattgttgcttccatcaatgtgactcccggttggtttcccgtctggccctgttgccaaggccagccagtgaaatcttccgttctgtttaaagagcttgatccagtcggtcccgctttccggggctgggagatcacttcgctgatcccgtgctatctggcggcttcaccagtcgtgtattgccgagtgctgctcggcgatggcgtgaatttagaaaactaaacagaattcgtcaacagttattttagatatcttaacttttgtggcgacgaggtacgctcgaacgctgactgcgtcaagacttacgcgattagaaaagttcggatagtctgcgtgtaaacctgtatggatatacagcaaccaaggaacagccgatggcgagcccgcagaagaaaacccaacagcaaacgcccgtatcgggagttgagcgccttacgctcagagtttccagcatgatcaaccatcccatcgctcaggaccggaagtgggcaaccatccacaggattgatagcgatggggatcgtgagtgggaggaggttatgggcgtgctcgccgacgttgacggtattgagatgactttcaacgacgaagatgagtcggttactttgagctgggaagccgcggccgaggaagatcctcgagttcaggatcatggtgagttagatgcgattgaagaggtcgcgccattctgacggacataaaaaagcccgctggtggcgggctttttgttaagccttacgggcattccagatcaacagcaccttggcgtggatcgtcacgtcgtcaattcgagccgtttggttttcatagtgtttgttgtcggatatcagcctgtagcactcttcgtccaggcgcattacgcgcttgatgtacagttctccatgccaagtgagaacgtatatcccctcaccgatgaaatcctttacacccttgtcgactatcaccagatctttgtcgttgatcgtcccggccatgctctcgccccagccgttgatcatgccgagcgatgacgcggaggtataagtgacccctttctctcggagaatttcctcacgcaccacgagatttcgaacgacctcggtatagtctggtggcacctgtccgtgccccatagcggctcggatattgtattgaggaatgacaatttcctcattcgttggtcgaaggctagctagatgactagggacgtaactcccgccgtgctcgactgggctatctgcttgctccgctgcagcgagcatcgtctcccgagctttttctgaaagattctttccagccctggacgcaagcattttagccatcaactcaaccgtggacatgccggccttggtgtcatcggtaaatgcctgatccggtgtaccgacaccgtcggacaaccagtccggcgagcaatccaaagccttcgccagcgccaaaaggtttttgcccttcgcgccattcgttccgctcacccagaaactgaccgtcgccttcgatacgccagtcagtttgctgatgtcggtggcgctgagattgagcgccttcatgcgtgaggtcacgcggtctttaaagtccatatttaggattctaaacatttcgctgtttagataacttgccttgtgttgttaagaaatctaaactcggcagagacaacggagacgcaccccatgacctttgacgaagccctgaaatatttccgcaccggtcgcgccatcggtgacgcgctccgcgttagcggtagccgtgtctcccagtgccgtgcggcaggtggattttcgtacccaatgcagtgcgttcttgaaaaggagtccgacggtgcattggttgccaagcgagacgatgacccagcgcagccaatgaaacagtccgcttaaccttgatgacgccattttccgctgaagcgggcagggcagatagagattctggatcagctgttaattcatacagtgcataggaagggaatagaaatggcagacaagaagggtgatttaggttttccggtcaatggaagcacagacgaacttgccgcctgggcttccaaggttatcgggagcgaaccgctgcttaggcgtctcgacccaattccagcccccgtatcagcgactgtagcgcggattggtgctcaccttgaccgtctcgtagcttgggttcttcggggtgtacgtcttgaaggcgttttgctgcggctatcaagttatccgcgtcgtttcgcgacacctcagccaaagcctgaccaatcagcaccagtgcagaagcaagccccatctcataaggggtaagaactcggttttcagtcatgtctggtctccgtgaccttttcgtggggaagcaaaaagctaccacggatgcaccggacacccataacgcctgaatcgcaggcataaaaaaaccgcctggcagggcggtcctttcaacaacttgtaaaacacagtggggccattatgaacaccaataccgctccaggcaatacccaccatgtcgcgacactttttcgaccagatcaaaacgtgtcgcgacacacgatgtcttcccgcgagatagcccaactcaccggcaagcggcatcccgacgtgaagcgcgacatccagtcgatgatccgcgacctgaaagaagatgtgagcagttttgctcacatctatttggacgcgcagaaccgcaatcaaaccgaatatttgctggatcgtgagcacactgattgcttgctgaccggttacagcgccccactgcggatggctgttgtccgccgctggcgcgaactcgaggcatgctcggaagccccgaaaatcccgacaacgcttcctgaagcattgcggcttgcggctgaccatgccgaggaaaacctgcgcctgattggagtcattgagcttcaagcgccgaaggttgcggccatcaaaaggcttgctgctgcggaaggggcaatctgcatcacggacgcagccaagcacctgggcatgccaccgtcgaagctcttcgactggatgcaggctaaccgctggatctatcgccgcggtggctccactcgctgggtcgcggcagagccccgcattcgctccggatacatgaagcacaaagtcaccgcgctgaagcccgacaccgagactggcgtcgagcgtgcggcattccaggcactggtaacaccaaaaggcctgacctacctggccgaaaagaatattggagcttcgctgtgagcgttcaagcaatgggctgggcgcttgccctgccaacggaaattctcaaagattcgagcgcgcgtcacgtgctgctttgcctcgccaactacgccgggcctaacggtgctggtgcctttccatccgcctcgaccctggcacaggacaccggcctgtctgagcgtaccgtccgctacaagctggacgatctggagaagtccgggttgatccagaagggcaatcaggctatcgccgctgtgcacatcgatcgtcatgaccgccgcccagtcgtttacgaccttcagatatcgcggggtgcaaatcctgcaccccgtacaaaacggggtgcagatgacgcaacggggtgcagcgcacaacagaacggggtgcagcctggaacagaacggggtgcagcagctgcacccaatccaccacttaaccatcaaggaaccgaagagcagctgcagcagcgcgagattgatgccgcgctcgccgaacagaacagcgccgccatcgaaccgcaggatgatcgccagcgcttcgccatgttcgccacctgggttccgaacgagaaggggctgtccgatcaaatcactatcgccgggcttcctgccgatgccgtccctgaagcggcgatccgggcgttcatggggttcttcgtcgccaagccagcaaccatcgacacctccgccggctggtgctaccggctggttcagtgggtcaagcgcgaacgcgtgaaagcttcggggcagggcaaggctcctgacttcgatgacaccagctgggcgaacgatctgggggatctgtgatggaagtcaagaaaccacgcagcaccgaacagctgctcagcacgatgggcaatcttccgccggtaacgctggttcagccgaagcagttgccgccgggtaccgccgacgtcgtgaacgcgctgttcaaagaattgcaggcgattttcccggcctggaaacaggcttggcctgatgctgagtcgctgaatgccgccaagcgcagctggatcaaggcgttcattgttgcagggattacgacccttgagcagatccggtacggcctgcagaactgccggcagatcggcggtgacttcgcgccaagcgtcggcaagttcatcaaatggtgccagccgacacccgagatgctgggcattccttcccacgacaaggcattccgtgaggctctcgaaaactcccacccaagccgttttggtgcgcgcacctggtctcatccggcggtccgtcacgctgccttgcagtgcgagctgcataacctcggcgacttgatcccggagaaagccagcaaggtgttcgaccgggcttacgacatcaccattcgccgcctggtgcaggggctcccgcttgaagaaatcgcagtgggcattggttatgacggcaacaagtcggccgccgagctggcttcggagctcaccgagcgagtcgcctgtgcgcaggtcgcccggatgggtatcaagaccgatggaaaggctgcccgccaagagttgctggccagattcggtatcgggaggcgcaatgagcaagctcacgaaggccgcgcgtgatcgtgactgccaggttcggttccctggctgttcttgcgagccgtccaccacagtcctggcgcactaccgcctggccggtacctgcggcatgggcatgaagcccaacgacttccaggcggcttgggcctgtggctattgccacgacattgccgacggccgcctgcgtgcgcccggggagttgaccaaatacgaggtccgcctgttccttgccgaaggcgtcatgcgcacccaagacatcctgatcagtgaaggaaaggtgaaactttgaagccattcattgcgaagccagtgcgcgccaggtccatcgaccgtgagggcctggagcaggccgcgctgctcaaggaagtcgcgctgcgttacccagtcgccgccaagctgatctaccacgtcccgaatggtgggcaccggcacaaactggtggcgatcaagctgaaagagcagggcgtgaaggccggtgttcccgacctggtgttgccgatggcccgcggcgggtacttcggcctgtacatcgaattcaaggccacggcgccgcatgacgccgccgtttccccggcccaggaagcttacctccaggccctgaccgatcagggttacctggccatcgtctgtcgcgggcacttcgacgccattgaggcaatcagggcctacctccttcaacctcaaaccagggctgccgcatgactcaactcaagacattaaccgtgactctctcagatgccgagattcgccgccatgcggccagcgaggtgcgcgaccttcgggacgcccgccaacctgcgttcaggtttcggtacaagaaggaccgcaccaaagggtcctggtacctggtcgtgggtagcgcgtggaacaagatcgcgaatttccccgacctgaacactaaacaaatgctagcggccctgccggcggtgcgtgctcgcttgatcaccgagcctgaggcaggcacggcgataggcacgtgggcgacggtcggtcagctgcttgaatggttcgacgatcgcatgggccgtgaccgtaacctgtcctccaagcgcaagaccactgcgcgatcggtaatgagcaagcatcttcgcccgcgccttggcgacctcctgctgtccggcgtgaacaagtcagagatcgaccagcgattgatgtggcccctgcaggctgagctttctcttgaatacttgcgcctgatctttcggctgctggtgttggcgtttcgccaggcggcacgtctcgggctgatccagacgaacccaatgaatgcgatccggttcagcgatttctccaaaacaaaaatcaagcccaaggcggcgcgtctgcgtgacgtccaggtggaggaggtactgaccggtctggcgatcaagttcaactcggctccggctgacgcaatgttggcgttgatgatgctgtgccatggctcacgcgccggagagacgcggatggctgaatggtcggacttcagtttcgaagagcgccagtggcatatcccggcggagcacaccaagacccggtgccagttgacccttcctcttacccctcaggtatgtgcgttgctgaagcgatatcacgcggctcaggcggcgactggttaccagggcaagtacctattcccttcccgtggtggcaagccactgaccgacagccaggcatgtgccgtgtttacccgattggcaggaggcgagtggacaagccatgacctgcgcaaggttgccagaacaggatgggtggatctgggtgtggacttcctcattggtgagctgctgctgaaccacgcgatgggtcacaacgtgcaggcatacatccacacgtgggtagaggcaggcaagcgagaggcgctggagaagtggcacgaatggttagacgggcgcgggtttagtgtgatccacaccattgcagagccattatacgaagtttcccatattccggcagaggccacggtttgcgtggcctccagccaaatcaacgacaaaccataggcgaggtttaaaaatggcatttgtgaccgcgaactacctcgctcctggtggttaccagttctccgaacagcgagaagtggagccttcgctgggcgatattgtgatgatcggcgccgacgagttcgtagttggtgcggtccttgtccctgattactggaacgcttacggcgacgtgaaccagtaccgttcggctcaggttgttttggcctacaaagctccggaggccaaatgaagaagtcccacggcccagcgttccgcgccgcgatgctggacctggccaaatgcccggtatgtcgtggcactgcggtaatcaagggtgttttccacgagcttccctgcgtgcagtgcaacgcctccggctgggtcaccgccgaaaccggtgaggcgcttccgctggaggtgctggtgacgcagctgagcattcgtctccaggccgccgagcaacaaatcgcgcaattcaactgcttcaagcctgccggtgctgaagcgcaatacaacgagaacaaccgccgcggcgccggcggcaccaactacacaggggattgagccatggctatgtataaggacgtgatgggcactctggtgcgggtgctggcagcagacaatatcgacaacagcaccaagcagtcctggcagaagctgatcgacgccgaccttcgccagggcggcaccggtagcacgctatctgttcgagacaagttcgattacgactgctgcctgtatgcgttgctgcaccgtcaactcgacccggcccagtgggatgtgctggtggccaagtactccactcacaaggccaacaaggtcggtgccatcggcaggttggtagcgcgcatggtttcgccggcaccgcagctgttcatctataaggcgctgactgcctgggccataccgaagctgaaaggtgtgcaggtaggcaagcggtccaccgacatgatcgtgctgcccgctgagttctacgacatgaacacctgggatctggctggctccccggagcgcacgcgccgcaactggagaggcggaatccacaagcgtttggagaagctcgaagagcaggccgtaatccacgcgaccgagatattcgacagtgagcaaatctttgtagatgccgcttgacccactggccgactggccgtaaattaaccccatcatgtcgatcttgcgcgttatgagagacgactaaaaattctgagccccgccactgtgcggggctttttcgtttctggagtatcggatggatcctactgacctcggcccgggcacagctacctggctgggcggtagtgccactgtcgtgcttggcggcttgctctggcttcgcaagttcttgtcgaaggatgcaaccgatcgcgcgatggacaacgccgatatcggcaccctgcgtcggctcaatgagctactcaaccaagaacgcgccgcccgcaaagaagccgagtcccgtgctgatcaattcgcgaaagagcggaacgatctggccgcagccgtgggcaggatggaaggcaagatcgaagccctgaccagtcaggtcgggcaactcaccgagcgcgtcaccctgcagagtgaagagatcacccgcctgcgcaccaagctcggaggtatcgcgtaatggacagatgcgcattggagttcatcgcacggcgttggtggaggcggactgaggtctgggctattgccttactgctggtaggtggtggtgctgttcttggctaccaggctgcttactgggcactcgccgataagcagagcatccagatcaccgacatccgcaaggcctacgacacggccatggaagagcgggataagcgtcttgaagagctgacccgcaagactggcaccgctgctgataaggcgtcgaaggctgcaaccactgcggcccaagctgctgacaaggcagacgaggctctgagtcggacagtgcagtaatggctcgcctccaaaccttgggcaacagagttgccacccaaggcagcaggctggcaacttccgcgcctggctcatggcgaacaggcaagaccacctcaagccagcgtggctacaactacgagtggcagatggctcggctggtccacctcaatgacaacccgctctgtgtgtactgccagagagagggaagggtgacagcggcatctgttgtcgatcacggcgttccgcatcgcggcgacatggatatcttctgggacaaaagccagtgggtctcgctctgcactcactgccactcgtccgtcaagcaacaagaagaacagcgcaaccatcgtctttagaggaatcccatgctcattcaacccaaccagccggctacctgccgagtacctggctgcgcaagtgtggccaaccgtaaaggcgctcagatgtgcgagaagcactacatgcgcaaccgccgcaacgggacaaccaataagctggacgtggtcaagccaggcgccctgactcatagccatgggtacaagcttatacacgcccccgatcatgagctccgacgtgccagcaaccgagtctatgagcaccgagcggtctatcacgcgcatcacggctctggtcctttcgtgtgtcactggtgctcggttgtcgtgtgctgggatgacatgcacgtcgaccacctcaacgaccagaaggacgacaacagcccagaaaatctggtcgcaagctgcgccgcatgcaatcagaagcggggctttcgcaagatgaccaagacgcatcagcagatgtcgagccggcgttacacggcgcacggcaagacgatgtgtctcaacgagtggagccgacaccttgggctgtcccgcaacgctattgagtatcggcttgaggcgggatggaagattgacgatgtcttctcgcctaggaagggacgctcgggaccaccaagccgcaaggtggacccaacgacagtcgggccgtggctgatggatgacgccaccaaggcgaattgaagcacgtcactgcctctgtgtggcacgccaactccccgttttgaggcccgggggcggtcaaattatggagatcgacttttccccagaccactccccctctcacgcgcagattatttcccccttttgaaaaaggaattcagcaaatggcaggcgtcaaaggcaagagcgggggcgctcgccccaactctggcggcgctcggccgggtgctggccggaaaaagaaggttgagccggaatcagcaaactcatctgcggtctccgtcgagttcgaggcgcagccacacggcggtgcactgaagcgagaaagggcagtaccggtcccagctccagagatggacatgctttccttgttgaccaagatcgccctgggcgagctggatgccagcccaatacaggttcgggcagccattgccgccgttcaatacacccatgtcaaaaaggcagatggtggaaagaaggacgagcagcagaaagcagccgagcaggccgctgggaaattctcccggcaggcaccacccaaattagtcgcaacgaacggtaagcaggtttaactatggagtggtcgacagcgtgccccgactgggagcggcggttggtcgcccgcgaatcgattatcccgccgccgatcttcgtggaggaggccgagcgcgccctgcagatcttcaaggaactacgcgtccctgatctgccaggtaagccacggatggcggattgctgtgatgagtgggtgttcaatttcgttcgctgcatcttcggggcctacgatgctgagactggcaagcagctgatacgagagttcggcctactgatcagcaagaagaacacgaagagcaccatcgccgcaggcatcatgctcaccgcactgatcctgtgctggcgggaggaagaagaacatctgatcctggctccaacccgcgaggttgctgacaacgcattcaagccggcggcggccatggtcagggctgacgcagagctgtcagcaatgttccacatccaggatcacatcaggaccatcacggaccgcaccacgcgaaactcgttgaaggtcgttgcggctgataccgataccgtgtcaggcaagaagtcgggcaaggttttggtcgatgagctttgggtcttcggcaagcgctccaatgctgaatccatgtttatggaagcgctcggcggtcagatctcccgcgaagaagggtgggtcatctttctgaccacccaaagcgacgaccctcccgctggtgtgtttaaggaaaagctgagctactggcggaatgtgcgagacggcaaaatcctcgatcgcaaaacactgggaatcttgtacgaattccccttgcagatgattgaggacaaggcgtacctgaggtcagaaaacttctacatcaccaaccccaacatagcccgttcggttagcgctgagtggttgggtgacgagctcaaaaagaaacagggcgcctccgatggcacccttcaacaatttctggctaagcatctcaacatcgagatagggctaaacctacgctcggatcgatgggccggcgctgagttctgggaggctcaggcggcaccggaaggcctgaccttcgagcaacttattgaccgttctgaggttgtcgacgttggcatcgatggcggtggcctggatgacttgctcggattcgccgcagctggccgcgacaagctcacacggcaatggttggtgtggacgcatgcctgggctcacccgtcggtgctggaacggcgcaaaagcgaggcaccgcgctttcgagacttcgccggcaacggtgacctgaccttggtcgagaccatcggtgacgacgtgcaggacgtcgctgaactggtggccagagtcgaggctgccggcttgctcgacaaggtcggagtcgacccctccggtatcggcgcaattcttgacgccctcgccgaggccggtattccggaagagaagatcatcggtatcagccaaggctggaagctgaacggtgcaatcaagaccactgagcgaaagctcgccgagggcggcctggtccatggcggccaaccaatgatggcctggtgctgcggcaatgcgcgggtggtaccagccggaaacgccattttgatcaccaagcaggcgtcgggcctggcgaagatcgacccgttgatggcggccttcaatgccatctcgctgctgtcgctcaatcctcaagcccaaagcgggctcgacaattacctggctgatgggttcttcggactcatcggctcgaactcataggctgaatatggcatctcgttggtacaacccgctgtcatggcgcatgttcggctacaccgacccgaagaccggcgaatacaccgaggtcgaaatggtggccgggggtaaacgcacgaaggcgggcgtcactatcacgtccaaggctgcgataactatccccatcgtctgggcgtgcgtgaagatcctgagcgaatctgccgccgggctgccgctcaagatttttgaagatacgccgtcgggtcgagtgctggccgacaccaagtcgcggcaagccagggtgctgagaaagcctaacccgtacatgaccaaactcaactttctaaagtgcgccgtggtgaacatggcgctacggggcaatgcgtacagcatcattgagcgcgccgacaacggtgactggatcggcttcatcccggtaagtgctgacaacgtcgagatcgatacgtctgatgacttgatctactgggtcactatcggcggggatcgttccccggtatcgccagagaacatgctgcatttcaagctgttcagcatggatggaatcaacggactgtcgcctgttgagtaccaggccgaaacgatgggtctcgccaagaccgcgcaaaactggtcagcgatgttcatgcgcaaaggcggctttaccggtggctacgtcatctatgaccagttcctgaccaaggtccagcaagcgcagatcatggagaagtttcctgatgtgcgtaaaggcgacataaacgatatcggctcaatggggatcttgcagggcggcccgaagatcgtgccggccgggctgagccagaaggacagtcagttcattgagtcccagcaatttcaggaggaggcgattgccggctgttacggcgtgcctctgtacctggccaaccgtgccggcaagacctcaatcatggggtcgaacctggagcaacaaaccagcggttacgtgacctttggcctcaagccctacctcgacgcaattgaggatgaaatcaacgacaagctcttccgcgataaaccccagtttgtggagttcatcgtggagggtttgttgcgcgcggatagcgcgggccgggcagcctactacaaggctgcgcttggcggctctggtggctctggctggttaagtatcaacgccgtccgcgagaaagaaaacgagccccgcctggctggcgaagaatacgaccgggtcacccggtgggagatgcagaccaatgctaagcaagattgaggttccctttgaggtgaaggccagcgatgagctcggtaacttcgagggctacgctgcggtgttcaacaacatcgacctgggcgatgacgtgatccttcccggtgcattcaccaaagtgaagaccacgcgagcgggccgtttgaagctggccctgttccatgacttgacgcggcttgttggctcggccgaattcacccaggacgaccacggcctctacatcaagggcaaggtcaacttagcggttagttacgcccgtgacgcctatgagctgatgaaggaaggcacgctcgacagcatgtctatcggctttaacacgatcctggcggcctacgaagaacgcgaaggtcgaagcgtgcgaatcatcaaacaggcggagctctgggaggcatccctagtgccgttcggaatgaacccggctgcacaagtaaccgacgtgaagtcggatatcagaatttttgagaaggccctgcgcgaccgcatggggctctcccaaaaggaggcggcagcggtcgcctcgctcggctactccgcagttcaccgcgatggtgagactgaggccacggcgaccgtggaagagctgaaaaaactctcacacacatttgaccaattttttaaggtgtcgccatgaccgatccaatccaggaagtaaaaagctcgctcgaaaaccagctgaaagaaggtttcggcggcttgcagaagaagtacgacgctgttgccgatgagctccagaaaggcaacaccgtcaccgccgagatgaagtctcagatcgaaaaccaaaaaggtgagatcgagcgtgtcatcgagcaggtgcagaagctcgaagaaaagggcatcaagctgcgcaaccagaacccggaaaagaaaagcttcatcgactttgttaagggcaacgacaactaccaggccctgaccaagaagactcagagctccgccgaaatcgaaatcaccaagtctgatatggccagcatggccgaggtcaaggtcaccagtgctggccttgttgcgccgcagtacgatccggtgatccaaggcgctccgcgccagaacttgctgattcgtgacctgatcccgaccacgccagtgactggtcaggccttcacctactaccgcgaactgctgcatacgctgggcgccggcatggtgccggaaggtggcgccaagccaaccagcaacgttaccttcgaacaggtcaccgacaccatcaagaagatcgctgtatggatgccggtgaccgacgaagcgctcgacgacgttccgcagctctacagctacattcaggaattgctgcgcttcgacctggagctgaagcgtgagggccaactgcttaagggggacggcaccggtaataacctgaacggcatcatgacccaggcgaccgttttcgacccagcgctgagcaaggccactgacacggccatcgacaccgtgcgccgtgcgatctaccaggcgcgcaagcagtcgaagctgccggccgatgccgtggtcatgtccgatctggactggatgaacatcgagctgcagaaggacggcgagaaccgctacctgttcgccaacctgcaaggccttgttaccccggtcctgtggggccgcccaatcgttgcctcggacagcatggacgagggtgacggcgaaacgaccggcggcgagttcctgactggctcgttccaacaaggcgcgcggatctacgatcgcatgggcttcaccatcaaggtcggcatgatcaatgacgacttcatcaagaaccagcgcgccatcctggtggaagagcgtctcggcctggccgtgcgtaagaagtatgccttcgtcaaaggccgcttcaagcacgtcgcctaactcaacccagcatcaggggcctaacggccccgaacaaaactcaggtgaatatcatggaaattaaagttctgtggggcttcgagggcgatcccgaaaagctcaaggttccaaatggccgagtatcggccggcaccaccctcgacgttgaggacgaagagttggcgcacgcgctgattggtaaaggcctcgcagaaaaggcgaaaccggcggcgaataagtcggccaagcccaacgagaccaagtaaatgatcgacctggcgcgagtgaagagtcacctcaaggtcgatgacgatgaagaggatgctctgatcgccggctactttgaggcggccaagtcccacgtagcgatgcactgcgacagggaactggtcgaggcggcgccggtagaacctgatcagatgggaattaccccagacgttgagcaggccatcctgttgctggttggccattggttcgcaaaccgcgaaggcgtggcgatgggcaccatatcaaccaccgtaccgctggctgttgagcggttgctcatgtacaggaagcgttactgatgagagccggcccaatgcgtcaccgctgcatgcgccgtggctacatcgacggcaaggatgccctcggccagccctcgaaggtttggggtgacctgggcaagctctgggcggagatcaacattccctccggtcgcatgtacgaggccgcgtcacagatgcaggtcacggtcaccgccgagatcaacatccgctaccgcaaggacgtggtggcgggccagcacctggtgcacgacggcaccacttacgaaatcatcgcgccgctggccaccaaccagcgcgacatgctgaaactcatgtgcaaaacggtgaagccaaaatgagcaacggatcgctgacagttctggggcttggtgagctgcaggccgatttcgaacgcctggccaagtccgtgggcaacaagattgccagggatgcagttatggctggtgccagggtggccagggacaaggcccgaagtactgcaccagttcgcacgggaaaattgaagaaaaacattattgcggtcagcgtgaaacaggctgacacgcctggcggcgctactgccggtattcgcgtaaaaaatccaacgggcaaacaatccaaggcgctcaagcgtcccggcaaaaaagggcgcacctcgaaaacggattacgaatcaccgttctactggaagttcctggaactgggcacatcgaagatgcaggcccatccattcattcgaccatcttgggacggcagcctgcctcagatcgaaaaggccgttgccgacaagctggccgaaggcatcgacaacgctatcacccggtaaccccaatgattgagaaatccctcatcgacaggctttcgcctctggtcgacgggcgagtgtacttcggcgttgcgccggtggacgccgcccagccacgcttggtgattcaaacggtaggcaccaccaccggtttcacgctcgccggctgggacggctcaagcgacctcactattcagctcgacgcctggggagagagcttcctcgaggcgctcacgcttgctggtcaggcctttaccgcgatgaccacggatgacgctgacttcaccaccggcagcgcagaccgcctggcggatgtgttcgagaacgacaccaaacttttcagcgtgagctgggaatacaccctgcaaccataggaggccacatggccgttcaaactccaacgaaagcgaagttcgtcaagacgcagggcacggctctcagcgtttctaaaaccaccaccctggaccccaaggatgaggccctgacctgggccgatctgtccgtcaccattaagcagcctcagttccagggcggccagtcggacgaaattgaaaccacggtgctcgccagtgtggccaaggagttcaccacgggcctggctgacaacggcaccttcagcatgtccggcaactggaaggcagacgacgaagcacagaccgtcctgcgtaccgcgcgcgacgacgccgagcctcgcgccttcaagtcggtgttcaaggatggcacctcctcgacgttccttggcctggtcacccagttcacctgggacgctgcgccgaacggtaccgtgaacggcacgtttaacgtgcgtatcactggcgccgtgtccttcgacctgcctccggtgactccataatggcgcgcacgaagatcggcgccgtggcggatctgcgctccatggcactggacccgatgcgcaacttcaagcatgagcgcctcaccatcgacgagtgggagggcgcccaggtggtggtaagggcgttgagcgctggcgactgggttgagtatcgccgccgcgctgctttggcggttgctgaagcccgtcaggatgctgggcttccggcccagcctccagcaactgaaggtgtcgatgaggcgccgctggagccgcgggtggagattcattcctcgccgctctatgcattcgtcctggtgcgggccttgctcgatgagaacaatgctcgagtgttccaagacgaggacgtgccttcggtagctgatgccttcagcccagtgcatgaccggctcgtcggcaaggttttcgagctgagtggtgtagcggccggcgctggcgcgcaagacccggtggatgccgcgggaaacgactgacggaggagccggagttggcgtttatgctgactcttgccctccggcttggcatgacgctccaggacctgcgctcacggatgagcgcggaggagctgttcctctggatggcctataaccaggagtcaccgctaagcgacacccgcggcgatatccaggcctcgatcattgctgcttcggtgttccaggctcaaggcgcgaaagtttcggctgtcgacctgatgcctaaatggaaggatgaggcggctgcggtggttgatgagacggcggaggctgaggagggagaacagctcttcaaggcgttcttgatggtcaagtcatccgagtgacgtaggttacccgccgtccgaggtcccatcctcatgctagattctctcttttgcaaggaagatcatcatgaggaagtgcgcggttttagttgctgtcgttatcgcaggctgtggaaattcggaaaggccggactcagaagttgtgatcgatgagtccgctctttcagtttactccaaagagcattacccgaagacttatcagcagtggggcgatgatggcgttgagcgaataaaagtcgctgagcgagcggcgttgataaagtcagccaaacagatgaaatgcgacagagttgaatacgtggggctctctgagcagatgagtagcccgcctaataaaatagttgtttttgccgactgcctgaatcgatggcgtttctacatcgatcagaattctgaaattctcagtagtgagagaaccaaataacccgccaaggcgggttttttaatgtctggagaaaagcatggcagggcaaacccttcgctccctgatcgtcagcgtctcagccgaaacgagcgcatatcagcgtgagatggcaagggctggccgcatgggtcagagctatctgcgaaccatcacttctggaaaccgtgatgcgactagttcgtggagatcccaggaggcagcagttcgagcccagggctctgcgatgcaggcgcttacatcttcagtgggaggctacgcaaaggccatggccggcgctctcgctgtggggaatgtcattcaccaggctgacagctggaatcaggtaaatgctcgactgaagcaggcctccacgagcactgaggatttttctgtaaatcaaaaggcgctatttgagatcagtcagcgcaccggtactgcctttgccgacaacgcgggcctattcagtcgttcgtccgcatcgatgcgcgagtttggctactcatcgagcgaggctttgggtgtcaccgaagcgttggcccttgggcttcagctttccggcgctggtgcagcagaagcctcctctgttatcacgcagttctcccaagctttgggccagggtgtattgcgcggcgaggagttcaactcagttaacgaaaacggtgatcgcgtaatccgggcgcttgccaccggcatgggcgttgcccgtaaagacctcaaggcaatggcagaccaaggcctacttaccattgacaaagtggtgccggcactgattagccagcttggtacgcttcagggggagttcaaggatctacctggctcggttagtcgagccactacaaccgtcagcaactcattccaggcttgggtgggcgggatggacggcgcgaccggcagtaccaaaattcttgcccgtgccgttacctttgttgccgaaaacatggacgtactagcggcgtcggcgcttactgttggtgctgcgtatggcagcctgaaagcgggggatttgatcaagagtctatgggctcaggttactgctattcgggaagcaaactcagctgaaatagggcgctctagggctcagcttgatgccgccaatatggcagtcagacgggcagcagccgagacggtggctgcaaatgcgcaagttgcggcgacaaggtttactgatgggcatgcagccgctctcagccgcttgcggatcgccaggcttgcagatgcgcaggccgccgccgcacaaactgcagctcagtccgcccaatcagcagcgacgtcgctggctgggcgtgctggggcggctcttcttggcgttatgggtgggcctgccggacttgcactgaccgtcggtgccgtggctgccagctaccttctgttcagtgataacagcgataaagcccgccaggctaccgtcgatctcaagcggcccgtagaggatttgcgcaaggagtttgcggcactcggtagagagcaggctcgatacaagctcggcggcgttatccagcagcaggccgatgcgcaagtggcggcacagaaggcgttgcgcgagatccgcgccgctgcccaaggcaatgacaagtggggcgatacctactcggccaacccattccagcgcgacagggcggtgacggacttcaatcgccgcattgccggcggcctggatatcgactcggctagccagcagttggtcgcggcaatcggcccaaacgaggagatgaccaaggctatcaatgcttctgcatcagcgtacggcgaggcgatcaaagcctccggcgattacggcgacgtcgccaatatgctctccgcccgccttaacgatgtggccaccgctgccggccaagctggcgccgggctgaaaaagattgcggggcccgacaagaagactattgagggctggaacacctacacaaaaaccctcgttgagcgcttgaactccgtcagggatgggggcgacctggttggcgaggtgaaccggaggattgaacgggagggcgttgaccccggtactgccgagggctggcgcatcctagccggcgcgatcaagggttctgaaacggcggccaaggcttctgaggaggcccaacaaaaagccaagaaagcctcggaggatatccagcggcaagctgagcagctcaacaatgcatacaagcaaaccctggacaaccttacccagcaggtcgcgctttacggtgagacaaccgagatagggcgtctccgctacgagctctccacgggcgagctgtcgaagctgtcggagaaaaacaaggtcatgcttcagggcaaggcgattgagcttgatgcgctaaatgccagaaaggcctatgacggcctgatgtctagccttcaaaccaaagagcaagccctgctcgcaacgacgaaagagcggatgcaggtgcttgaaacggccaaccgtgccggcaagctatcgtcggacgactatcgcgctggcgctgatgccatctcgaaagccacggttaccgaggcgccggagttcggcggcatcgactcctcggtaggtggaccctccggggagcttgtaaagatcgccgaggctgaagcagcgctcaaaaagtggcacgacaagcagctgtccatgcaggcagatctgcgcgatcagatcctggccgaccagcaaagcaccaacgagcagaagctcgccgccgagcagcagtacctggaccgagtcgtcgagatcaatcagacgaaccaggcgcggctttctgacattcagggtgcctacaaagtagctgtgatcggcaccttcagcgaactgtcgggccaggccgccgacatggttggcaagatcgctggagagcagtcaggcgcatacaaggcattgtttgtagcgcaaaaggcgtttgcggtggcgtcgatcatcatgaacgcccagatcgctgcagcgaaggctccggcggaactgaccattctgggcggtatcccggtgggcgcggcgctgctggctgcgggttacgccaatgcgggcatggtcgccggcatggcgctggccggcttctctgagggtggctataccggccccggtggcaagtttgagccgaagggtgtggttcacggcggcgaggtcgtcatccgcaaggaagtggtcgatcagcctgggatgaaggattacctcatcggcctgaaccgtagcggtaagccgggctatgcaaccggcggatttgtcggaagcccaggcatgtcgccggccttcaccgctccatctgttgcagccgccgccggctcaggatctgcgccggagatccacttgcacatcaatggcgacggatcgggcggggcggtcaacgctccggaaggctacgagcaaatgggcctggcgctgctggccaccgctcgttccgaaatgccaaagatcgcccggcaggtgattcagcaggaaaaaggccagaacggcctgcttgatccaaacaatcggagaaacagctgatggcagaggtattcaactggtcgccccgggttggctcttccggtgacgaccagcctgacgtgcttgagtcgaagttcggcaacggctacagccagcgattatcggtcggaataaacaatgtcgccggtgcgtacaccgtttcctttacgggcggggaggcttacatcaagccgatccgggagttcttcaagcggcacaagggggcaaatcactttctgtggaccccgccgcttgaggttcagggggcgttcatcaccaccggaggctggcagctgcaaacccacggcaacaagaagtacaccctgagcaccaccttccagcaggtattcaatccatgatcacgttggacgaccagaagctagagcccggcgcgatcatccagttgatcgagctggacggtgaagcgcgcggtatgggcattttgcggtaccacgcacaccagcagtccaccccgatcatctggaagggcgacgtttacatgccccgaccttacgaaacaggtgggttcgggcgaagcgtcgagggcaacaactccacccccatgctgaagatcagcaacatcgacggcacgatcaccgcactctgtcgccgcttccaggggatgagcggggtaaagctgacggttcgacagacgtacgcgaaatacctggatgcagcgaactttccagagggcaaccctacggccagcaccatggaaaggctagacatctcctatatcaaccaggtcaccagcctgttgcgtgaagaggtggtgttttcgttggcccctccgactgctgttaaaggtcagaggttgccgggcggcctgatcatgaaccggtgcgaatggtgcctttggggcgagtaccgcggcccggactgcaactacaccgggatcaagatgttcgacctcgacggcaacccggtggacgacccggcgctggatcgctgcggcggccggccgagtgattgcgaattacgttttggcaagggcaaccccttgtcgttcggtggcgcaccaggcgccgcgctgatcggataagcaaaccatgaacaagacgatgctgaaacaaattcaggcccacgctgaggcggagtttccgaaggaaagctgcggcgtggtgattcgagaggccgggcggctgaagtacgttccctgccgcaacgatgccaagacgccgagcgagcacttcatcatcaaccctgaggataagtgtgacgctgaggaccgtggcgaggtgacgatgatcattcactctcatcccgacgttccacccatgccgagcatgaccgatcgtgtcagctgcgaattgcatgaaaagccgtggggtattgtgagctggccgtctggcgagtacttcgagttcaagcctgatggttaccaggccccgctggttggccgcgagttcggccatggtctgctggactgctatgccctgtgccgcgattactacgagcgcgagcatgggattgaattgccgaactacccacgccgggacggctggtggaacgatggtgagagcctctacgagaaatactacgaggaggccggtttctatccggtttcgatgccgcgcaagggcgacatgatcgtcatgcagatcaacgccgctgcaccgaaccacgcaggaatctatctgggtgacggtttgctgaccagcgccccggaactacacccggccccgggcacctttctgcatcaccgctacaacaagaaatccacccgagacgtgtacggcggcatgtgggctgattacaccgtgctgattcttcggcaccaacgcatgcaggaggttgactgatggcaatgaaaacaacggttaacccgcaacccctagtggtgctggtgatgctttatggtgtgctgggcgcacgatttggccgggtacaccacctggccgtgacgtcatgcgctgaggcgattcatgcgttgtgcgtgaagatccccggcttcagacggttcttgcgcttttcggaagagcgcggtctgacctacgcagtgttccgggggaagaagaacctgagcgataccgagattgagatgcgtcaggacaccgttgagccgatccgcatcgcgccaatggtgatcggcagcaagggaggcggcttgttcgccacgattgccggtcttgccctggtggtgatcggcgcgatcactcagcagtactacttggtagcggctggcgcgggcctgatgattggcggcatcgccatgagtatgtccccgtcaccggttggcgtgctggacaaggagggcgacggcaacaggccttcctatgcgttcggtggcgctgtcaccaccacggcccagggccgctgtaagccacttctgtatggcgagcgcgatatcggcggcgccctcatttcggccggggtcttctcggaagatcagcagtaaggaaaaaccatgtccaaaatcgcaacagcgcctgctgtaaagcatcggcgccggcctactgctgcccgcgttttgggcgccaagggcggcgagcagaagccgtacacgccctacaaagcacccgacaccgcgctttctgtcgcgaccgtgaaactgctctatgccttgagtgaggggccaattattggcctggtcgatgatagacggtcggtaaaactcaacggcacgccgctggtctcgcctgacggtagcgagaacttccccggcaccatttgggacttccgcccgggcactgtggaccaagaacacatcccaggctttccggccattgaaaacgaggcgtcccaggggttaccggttgagctgaagtcggacaacgcctggacgcgcgcgatcactgatcagcagttgtcggcggtacgcatccgcttgtcgtggccgcaaatttggcaggtgaagacgaatggcgaccagatcggctaccgcatcgactacgccattgatctttccgtagatggcggaagctatcaaacagtcctttctgcaactttggacgacaaagggacaaccgaatacgagcgcacccatcgaatcgacctccctgagggcttcaccagtgcgctggtgcgcgtgcgccgactcaccccaaaccgaaacgactccaattttgcggacctgatgcgcatcaaggggctgacggaggtaatcgacaagaagctgcgctatccgaacctggcgctgggcggcctgcagttcgatgcaaagcagttccaagacacgccgaaggccagcttcctgatgcgcggccgcattgtgcaggtgccgaccaactacaacccggagactcgaacctatacaggtgactggaacggcacttttaagcttgcctacaccaacaatcctgtctgggtatggcgcgacctgttgttgcatcgtcgctacggcctgggccgtcgcatcaccgccgacatggtggaccattggacgctgtacgagatcggtcgctattgcgacgtgatggttccagatgggaagggcggcatgcagccgcgtatgaccaccaacgtttacattcaggattcggttgagggctacgcactcctttcggacctggccagtgtgttccgtgggagcagttgctggaacggttcccaggtcaccatggtggcggacattccgggcaacgaggacggctacgtcttcacgcgctcgaacatcattggtgagtttgaatacgtctccgcagcgcttcctgaccgtcatacgcgggcgaaggtggcgtgggacaaccctgaaaacgaattcaaaacccagccggcccccgttaccaacgaagagctgatcggtgagctcggtcatcggatgctggatatctcacgattcggttgcaccgtggagggcgaagcaatccgccacggtatctgggcgctcaagtccgagcagtacgaagagtggtcggtaaccttcaccaccggcatggaagggcgcaacgtcgagccaggtcagattatctgcgtggcggacgagatgttctccggtcgcgcaaatggtggccgcatcagcgctgctaccaagcgcgtgattaagctggacatcgatgccgaggtgcatgaagaggatcgacttattctcaacttgccgagtggtaagtccgaggggcggatcgttaagtcagtctctggccgcctggtcaccgtaatggctgattattctgagttgccggagccggagtgcagttggtccgtggaaagtgccgacctagctgtgatgcgctttcgggtgcagaccattgacccgcaaggcctgcaccagttcaagatcgcagccacacagcatgagcctctgaaataccccgcgatcgacaacggtgcacggatcgatccccagccaaccagtgtaattccgccaggtgtaatgtcgccgccggcgaacatcggcatcgaggcgcgcagcgtcgtgtcgcaaggcattgctgtcaccagcatgcgtatcacctgggactcggtgcccggggctattgcgtacaacgtggaatggcgcaaggacagtggcaactggatacgcttgccacgtaccgggaatctcggtgcggacgttgagggcatttacagcggccgctacgttgcgcgtgtcagctcggtcaacgccatggacgtggcgtctatctggggcaccagcactgaggtggtactgaccggcaagactggtctaccgcctgcggtgtcgttcctgaccaccaccagcctgatttatggcatcggcatccagtggggattcccaccaggtgcggaggacacccaacggacggaactctggtacagcgagtcgcccgacttgacgacggcggtcaagctgagcgacttcagctacccgcaggcctcgcacgaaatgcacagcctgttggcgggggcaagtctgttcttctgggcgcgcttggtcgaccggaccggcaacgtaggcccgttctggcctgtacctggtgcagtccatggccaggccagcaccaagcagagcgactatgaggcctactacgccgagaagatcggcaagggcgccctgtaccagagtctgcgcgaagaaatcgaactgattacaggcgatgggcctggctcagtaaatgagcgcctcgaggaagccaagcaggagctggaagatctgatcaagcaagtgagcgatgccctcgcttacgacccggaaaagccctatctgaagggcgacatcgtgcgtctggatcagcgtctctaccaagcgaaaggccctgtgcctgtgggagcaacgccacccgacgccacttactggatagatatcggcaccatccttgagaccactgacgcactggtttcccaggtgcagatcatcgaaaccaagattgaggaaatcgacggcaaggtgttggccaccgccacctcagttgaggctttgcgctcagctgctcgtggggatgacggcgccggcgatctggcagacgcaatcaaaggatggacatcgacggcggatctggcggtcgagcgtaaaacccgagccagcgaaaacgatgcgatggctcagcagctgctcaccctgggtgcccaggtaggcgacaacaagtcgtcgcttactgtcctggaacaggttgttgcatcgaaccgcgagacgtccgcagcgcagatcaccaaactgaacagcgatctgtctgcggtcgatcaaaaggcgaacggcactgctcaggcgctcaccagcctcgacacaaaagtcaccaacctggacgggaaaatcacctctcaggcgtctagcaatgaggcgcttcgggcttctgtgcgcggcgataacggttctggcgaactggcgggagcaattaaggcgtgggagtcaacggccagctttgcggccgagaaggttgtgcaggcgagtgcaaacgaggctttgaccaaaactacggaaacgctgcagtcgagcatcggacagacaagcgcgtcggttcaaacggtgagcgagacagtggtacggctcgacggcaaggtttcggcacagaccaccatgaaggctcagaccatcgtggatggtaggagggtggtgtctggtctggcctttggttcgaacggagagcaatcggaatttctgatcttcgctcagcgctttgcagtggtgaacgaggtgaatggaaaggttgatccgatgtttgtgattgaaaacggccaggccgtattcaacaccgcgatcatcagcaaggcgatcatccaggaaatcatcttgggcatggtgcttcgttcgccgacggtggactcgaaaggccgtccactgctggaaatcaacattccggcgggcacggtgactgtgcgtggcgaaggcaccgacggttcgagcttgttcgataacagcggtatctcggttttcgatgcgaacgagaagcgtcgaggcaagttcgggaggattaactgatggctgaatatgggctggctacctgggacgagagcggggttcagcaacttggccccgcatctttcacgctccgcaccgttttctcaacgctggtcaccttctctggaccggtcactggcgccggcgctgcgcaggtcttctctgtgccaggggtgaccccactaaactgcatcgctatcgttgtgccgattgggccatatacaaccgggttacacacagtagttcaatacgaacctgaaatacttaccgaccaaatcagggtgtggagggggcacaggaccgctgttgatggacggtttgggactgggacccagcgccttatagtgtcgaggtacaaataatgagttgggggtttgagttcaagaataatgacgatgtcgttattctcgattctgaatatgcgcgtctttcaattctctctaaagggcgttttgtccctacacaagagtctggtcttggctcttcgacaaactttgagagggttataaccactcaagaaccaccgctggtatttgtcaagcctgacaatgttggaataattgctggtctctgtagggtcctcatacttgggtcgccgggcaactggacaggcttttacgttcgagcatatgacgtgaacacggctcagcccaggggtaactactttgcagcagcattctcagcaagccctacagctctatggggaggccgactttatgatcagaatgagtctttgatttttgacacgggaactcccagcgcagtgttcagcaaatctttggcctcttggagttacgtgacatcaggaagtgacgcgcaaggccagactatggtttattttagtgttccttttgtgttctctagtaatgagtacatgctgattaataacttcggcatggatgtcgccgggagttcatttcgagcttcagctttgtattgttggtgggattttcccgcaaatcggttatgggcgattactataggggtaacaccacaaaacactctttatatacctgctgtgttcgcgaaaatgcaagcgtgactcttgaggttaatccttctgttataaattttgattggagaaaagcatggcttcttggttttcagaagggaccgttaccgttacgaacggcaacgccgttgtaactggtgtcggtacaaagttttctaactgccgatccggcgacatgtttgtcggtccagataacggcatctatcaggtgatcaattcttcgagcgacacatccatctcgatctcgcctgcatatcgtggcgccacctccgcaggcgccgcctacggcatcgtgcctgttaatggctacccaaaggctttggctgatgcggttaatctgatggttcagcagtggggctctacgctggccggcctgggcactgtctcaaccgagaacgtggtgccagttgcgaagggcggcactggcggcacaactcaggcagccgcaagaacgggacttggtttgggtacggtggcaccactaaacacgggccgggcgccaggtaatgtaccgacaacggaaatgattggcttcgtcggcagtcagtcaactgtgtcatggacggctgaggtcaaccccggcatcgataataaggttttcgcatcggctgactttgctggaaaccctcaaggaggcacggggctttactaccgtcaaaccattcagtttggcaccactggtaaccggctgatgattgcctggccgtatggcgttgcgggcaacactggcactatcaagctgcgatcgatctacaacggcggcttcactcctgaaatcgagttgtatcacaccggcaataccactcgtgcccaagacggcactttgaaggcgatatgactatggcaagagcagcaatcaatatcgtgggccagacaggtgctttgtttgatatcacgtcgcttggcggcaaggacgtcgacagttaccgagaaagcgtgggcgtgtatcgcgtcaccggcacccaagggatggtcccattcccgcccgtggatcaggggtggggatactcgttacacccatcggagaatactgcccaggtggatatcgttttcagtgatggtctattgactgtcacggtcacaatggatggtgagccctacgacctgaacacgatgatcacactgcacattttagtgccagatctgccacacgaagatatacccccgacgccgccgatcacgaccaatccactgggcgttgctcaggccgagattcagcgtctgcgggccatcgcggattacgccgttgcgcccctacaagatgcggtggatggcgacgaggccacggatgcagaggttgtcctgctcaaaggctggaagaaataccgcgttgcgctgaaccgagtccccgaacaggatcagtacccggacgctatcgagtggccaagtgccccggcgtgattgccattagctgaccgatgcccgccttgagcgggttttttttcgcctggagaaaagcatgaccactaccgaaaaagaccgagacatcctggcgcgtacgctgtggggcgaggcccgcggcgaaggattggcaggccagatcgccgtggcctggaccattcgcaaccgcgttttcgacggcaagtccgcatcctggtggggggagggttacaccggcgtgtgcctgaagccctggcagttcagttgctggaaccagaacgacccgaactacgcttacctgagcggcgccaaacagatcccggccgcgcagttcgcccaggcccaacgtgcggctgaccaagtgatgtccggcgcggtaccagatccaactggcggcgccacgcactactacgcaaccacgatgcccaaggcaccggcctgggcggcgaaggccacgcagacgctgcgccttggtcaccatgtcttcttcaaggatgtgccgtaatgacgccggggcagatccttggcgcgatcctgctggcgctggccctcgggtttggtggtgcgtggcaggttcaggactggcgctttggaaagcaactggcagaaatcggtaaggcccaggcgctcgccgttaccgaggctggcaacacggcccgccaagaagagcaacgccgacaatcggcagtgaataaggaagcaagagatgcgcgagaacagattaaggctgcaactgtggatgctggcaccgctgatgctgctggcgaccggctgcacgtcgaagtcggtaagtttgccgccactgcctgcggcaatcccggagctgccgagcgaggcgcgtcagccacccgcgccgcaatggtgctctccgaattgttccagcgggctgacaagagagcgggggagctggcagcagcgtatgaccgagcccgaatagctgggcttgcctgcgagggaagttacaagggcatcagatcagcgagagaatgaaaagcccagcggaatggctgggctttattgggacttgttgagcatgtccatcaagtcctttgaactctgcaggctcagaggtaggggggtgtcagaatctattccggacttttctctatggtggaagtatctcagcaatgcgatgagcaatatggttgggatagaggatagtgccaggattattgggacatcagtcactacgtgaggcttggtcgaaaggaaaaaataccactttccgataacaagcctgaagtgtccaagaaatatgaaaccaagcaaaaccgtatagaagccaagtatcaggcagatggcaagctttgcgagcccttgctcccagctatacctccatatttccttctttaagtagcggtcaagcattttgctattgatcgagctttcgccggcacttaagtcttcgccttcctggctcatattatcccgatattccttagtcgatattccattgccgcagtagacacgccgaacgtacgagcgagaactccgaggtcggtaaccttctcttcaaacaccatgtgcttcaccaatgccgcaggcatcaacaaggatgccgcaaatcgattagccgcaacctctctagggtcccgaaccccagaactgaactgtgcagcggtatctcgaggagcgtcgacatcgccatgcacgtggtgcccaatctcatgtgctagcgtaaaacgctgacgcacagcggagtcgtttgggttatacgtgatcaatggcgctccatcacggtagctgtaatgaccgctttctgacccgacattcaatgggttcgactttttgacctcgattcccattgcgattgcgattgcttctggatctactggaagcttgaagtcccagtgcgccttgaggacgtcaagcgcggtgctgtatctcatgcgagcctcctcagactgtagtttcgtgggtaccggttagacgggtgattatgatcctgaagtcacattagtcaaattaccatttgtgaacaaattttgatctatcttttcgtttgtctccttcggcgcggtttatgcagcccgtcgagcccagcttgacccagcgcatgcgcaacgaattatcgccatcaccgatgacggggataacgccataatcgcgctgcgtgcgtgccaggcgtatgtcagggctgtggccccctgagtgcagccagttcaagcagaagccgctgattttctatgcgcaggtgctcgttctgatttgagatcatctttaggcccatgatctctttgcctctttccgagtattcgacatttgtacggctaagctcgacctcaacagctcgaagcttttcttcagctgccatcttgccggtaaccagcaggtcgttcatctggaccaggccggcgatattcgcccgcgctctgcgcagcatgcgctcggtctcgaccagttcgtctacgagaagtgagcactggtgttggtacatctccagtggagtggggcagccgagccaatcatcggtgtccatgtcaacgttcatagcgtgaatctcaaatactgtatgtgtgtacagtaatcgaggtatggcaggtttggggagtggtgttcgtcggcaggacgccggtggcgggatttcgcgttggagtttcttccccaaaacgcaaccgtttggaccaatgtttattggttttagaagagtcgcaaaagtgagtatttttggagggtgtttttagggtcaaggccttgatattaaaggccttgagcgtttcttatgcggcatcccaggctttgatgccgaaaaggtgcaaggttttgcttgaagcggtcaaggaattgcccccctttggacgtacgaaaatgaaaggtcacggattatgccacgaccagcaagtttcggcgccgctcgtcaacactctgcgacttttgtgcaaaagcctgcgcgtagcatgagcaggtaacatagccgggtaatatggcacttcaacggccagttgttgcctcacgtgtgtcgttgcaagtcgattgtccgggaaacccgcgttatgcaaactgcctataccgttcttatcctgctgatgctggtcagcgtttcgcgccttgtcgggcgtgtcattcctctgcccctgccgctggtgcagattgccgccggagccttgttggcctggcccacgctggggctgcatgtggccctggacccggagctgttcctgtttttgttcctgccgccactgctgttctcggatggctggcgcatgcccaagcgcgaattgtggcgtctgcgcggtccaatcctgacgctggcggtagggctggtattgttcacggtggttggcgccggctatttcattcactggatattgccgacgattccgttgccggtggccttcgccctggcagcagttttatcaccgacggatgctgtggcagtgtcggccatttcccagaaccgtttgcccaagccactgatgcatatgctccaaggcgaggcgctgatgaacgacgcgtcgggcctggtgaccttcaagttcgccctggcggcggcgttgaccggggtgttttccttggcggatgccagcctgacgtttgtgttggtcgccgtgggtggcctggcggtcggcgtggcgttgagctggctggtcggccgcctgcgcgcctggatgatcgcgcggggctgggatgatccggcgacccatgtggtgttcatgctattgctgccctttgctgcctacgtgctggccgagcgcctgggcgcttcgggcattttgtcggcggtggcggcgggcatgatgcagagctggctggacctgctgccacgccagaccagtacgcgcttgctcaatcgcagtgtctggtcgttgctggaattcgccttcaacggcctgatcttcctgctgctcggcttgcaattgccggacattatcaaggcggtggtgagtcacgaaaccacgctgtggcccaccctgttgtatcgctgcctggatgtggtggcgatcttcctggtgctggtggtattacgttttatctgggtgcaaagcatctggcgcctgtcgggcttgctccgcaggctgcgtgggaaaagtgcgctcaccctggtgcccaccgcccgttcctgctggttgttgaccgtcggcggtgtacgcggggcagtgactttggccggtgtcatgtcggtgccgttgctgttggcgccggggcaggattttcctgagcgcgacttgctgatctttatcgctgcgggagtgatcctgttgtcgctggttgctgcctgtattgcgctgccgctgctattgcgcggcgtagagaagagcccggatgaaaagcgccataacgaggtgcgcgaggcgtggaaaaagactgccgtggcggcaattcatgctctcgaggttgaggagcccgcagaggccgaaccgtcggatgcggcccaggctgcattggctacggagctcaaggcccggctgatgtcggaataccgccaccaactggaggtcttcaatgattcggccgaagcccaggcgctggcgcaacagatggatcagctggagcgcaaactgcggctcaaggccctgcgtgcacaacgcctggagctatatagcttgagccgtcatcaccagattggcgatgacgttttgagggaagtgctggcagagttggatatgagtgaggcgaacctgggtcacatgaagtgacccatgggcctttatcggcgccgttggataaagtctcgaatccgctcggccgcttccacgcattcagctagcggtgcaaccaacgccatgcgcacacgcccggcgcctgggttgacgccatccacgtccctcgacaggtaagagcccggcaccacggtcacgtgttcctctacgaacaaatcacggcagaaagcggcatcatcgccattcacgttcggccacaaataaaaaccgccgtccgggctttgtacgtccagtaccggcttgaggatcgccagcaccgcgtcgaacttttcgcgatataggtcacggttggcctgtacgtgggcctcgtcctgccaggcggcaatgctcgccagttgggtttgcaccggcatcgcgcagccgtggtaggtgcggtacagcaggaaggccttgaggatgtcggcatcgccggccacgaagcccgaacgcaggcccggcagattggaacgcttggacaggctgtggaataccacgcaacgcttgaagtcctggcgccccagctcgacgcaggcactgagcaggcccggcggcggggtttgttcgtcgaagtacagctcgctgtagcactcgtcggcggcgatcacgaagtcgtattcgtcggccagggcgatgagttttttcagggtgcccaccgggatcagcgcgccggtcgggttgcctggcgagcacaggaacaggatctggcagcgtttccagatatccggcgaaaccgcctcgaaatccgggttgaagccgttggcatccaggcacggcaggtagtgcggcttggcgccggcgaggaacgcagcgccttcgtagatttggtagaacgggttcgggctgaccaccagcgcatcatcgccgcggttgaccacggtctgggtaaaggcgaacagggcttcacgggtgccgttgactggcaggatgttacgcgccgggtccaaccagcccttgggcacgttgaagcggcgttcgcaccaggcgccgatggcttcgcgcagtgccggggtgcccagggtggtggggtacaccgccatctggtcgagattgttgctcaacgcctcggcaacgaatgctggcgacgtgtgcttgggctcgccgatggacagcgcgatcgggcgtttgtccgggttcggcgtgacactgccgagcagagcgcgcaatttctcgaaggggtagggctgcaactggttaagggcgttgttcatcgaagatctcgtttaattcagttgtaatgcgatgggccggacaaagcagatctaaaggtgggagggggcgtgctcccgatagcggcctgtcagttgatctctttgttgctgacccgccgctatcgggagcaagccccctcccacaataagccgggtgttcaaatggtcaggcgcgtcagctcaacgccaggttcctgggtcacgctcaattgctggacgatggcgtcctgcaaacgtcggcacagttccgggtcggacagcggctggttgtcggcatcggtaataaagaacacgtcttccacccgctcgccaagggtcgcaatcttggcgttctgcaatgacaggtcgaactccaggaagatcccgccgatgcgtgccagcaggcctgggcggtccggtgcgctgagctccagcaccgttaccgggcgctgggcatcgttggaaatggtcacctggggcgcaaaggcaaaatgcttgagctggcgcggcacccggcgctggatgatggtcgggtaatcgtccgggttgcgcagggcttcggtcaggccctcgcggatctttttcacccgcgccgggttgtcgccaatcgagtcgccgtcggtgtcgagcacgatgtaggtgtcgagggtgaactggctgctggaggtgatgacccgggcgtcatggatgttcaggttgagctggtccatggcggccacggtcacggcgaagaagtcgtgctggtccggcgcgtagatgaagatctgcgtgccgccttcgaattcgcgctgggtagtttccttgatcagcaccaaagggccgccatcggccggttgctgcaggatcgcgtcgctgtgccaggctacgtcgccggcggtgtggcgcaggaaataatcgtcacccagttgcgaccagagttgctcgacgtcgtccgggtcgttgccaccgcgtacgaggatatccagggccgcgctctgggtgcggcggatctgttcttcgcgatccaccgggttctccaggccgcggcgcagggcgcgcttggtctctgtatacaactggcgcaacaggctggcacgccaggaattccacagcgtggggttggtggcgttgatgtcggagaccgtcagcacatacaggtagtcgaggcgggtttcatcgccgacgactcccgcgaaatcgtggatcacctgcgggtcggacaaatccttgcgctgggcagtggtcgacatcaccaggtggttttgcaccagccagacaatcaggcggctgtcccacaggggtaactggtgacgctggcagaaggcttcggcgtccaccgcgccaatttccgagtgatcgccatgccggcccttgccgatatcgtgatacaggccggccaggtagatcagttcgggcttgggcagtttggccatcagcttactggccagcgggaatttctctgacacctgggtgtactgcaacttacgcagatgcttgatcaggttcagggtgtgggcgtcgacggtatagatgtggaacagatcatgttgcatttgcccgacgataaagccgaactccggcagatagcgcccgaggatgccgtagcggttcatgcgccgcaggttgcggtggatgccgatgcggcacttgaacagctcgatgaacaggctggtgttgcggatatcgttgcgaaattcgtcgtcgatcaggtggcggttttcccgcagcaggcggatggtgtcggcacgcacgcctttgatatccggctgctgggccattagtacgaagatttccagcatggcgaacggggtgcggcggaacacgttgtcgttgcgtgcctcgatatagccatcgtgcagctggaagcgcgcattgatcggctgcggcggcgcttcgtcttcgggagccaggatcacctcttcgaagtgctggatgatcaggtcactgagctgggcaatgctcatgaccacccggtaatactgctgcatgaagctttcgatgctggtcttcgcgtcttcgccttcaaaccctagcagggtggcgatggagcgctggtgatcgaacagcaggcggtcttcggaacgtccggccagcatgtgcagggcgtagcgcaccttccacaggaactcctgggacgaggccagcagagtgttttcgctttccaccaggaagccctcgccggccagggcgcgcaggttcagcgtgccatattggcggcgcgccacccacaaaatcgtctggatatcccgcagcccgcccggggagcctttgacgttgggttccaggttgtattcagtgtcgttgtacttgtggtgccgcgccttctgttcggcgcgcttggccaggaagaaatccttgctcggccacatgtgtgcagtgctggtgacttcgagcatgcgttggcgcaggcgctcggggccggcgatggtgcggctttccatcaggttggtgatcaccgtcaggtcggcgcgggcttcttcggcgcactcggctaccgagcgcacgctctggccgacctccaggccgatgtcccacagcaacgtcagaaaacgctcgatagaatcgcgaaagatctcatggtcggcgctgtccagcaggatcagcaggtcgatgtcggagtaggggtgcagttcgccgcgaccgtagccgccgacagccaccagggcgatatcggcgtttgcactccagctgaactgttcccaggccttttgcaggatgttatcgacgaaccaggcgcgatcctcgatgaggcgacggatgtcccgaccgctgcgaaagcgcgcgtcgagcacctcgcgggcttgacggatggccttcttgaaggcggcgatggggctcgccttcagtgccagctcggcctggaactggccgcggtcgaagagttcgggatccacctggggcatcgatcggctttcctttctatctaatagtcagtcacagcacagcgtgggaaaaccagcacagcctttttacgcagagacgcgagggattgtgtcgtcggcgcgcagggtgaagatctcgtagccggtgtcggtgaccagcagggtgtgttcccactgggccgagagcttgcggtccttggtaatggcggtccagccgtcgcccagcaccttggtgtcggccttgccctggttgatcatcggctcgatggtgaaggtcatgccggccttgagttccatgccggtgccggccttgccgtagtgcaggatctgcggctcttcgtggaacaccttgccgatgccgtggccgcagaattcgcgcacgaccgagaagccgttcttttccgcgtgcttctggatcacttcgccgatgtcacccaggcggcagccaggcttgacgatctcgatagccttgtacatgcattcctgggtgacctgggacaggcgctcggcccacaccggcacgttgccgacgtggaacatacggctggtgtcgccgtggtagccatccttgatcacggtgacgtcgatgttcagggtgtcgccatccttcagcggcttgtcaccgggaatcccgtggcagaccacgtggttgatcgaggtgcagatcgacttggggaagcctttgtagttcagtggggcagggatggctttttgcacgttgactatatagtcgtggcagatacggtccagcgcctcggtggtgacaccgggcttgacgtgttcggcaatcatttccagcacgtcggcagccagtttgccggcaacgcgcatgcctgcgatgtcttcggcggttttcaaggtaacggtcatacaggctctctctagcgcgacgcgctgaaatcaatacggttcacggggggcgcgacaaaggggtgaagcattcgcgcaagtcccaaaaaacgcaattctaacagacgatggtgtcaaatcatgagcgtctggtgatcgcttctctctatcaaggtagcgccagggtcgctctattcaagggtttggctaaaggcggcggggcaaatgtgattgcgggtttcgtttttgtcgatgctgtggtataaaatgcgccgctttccggggataccccgcgaagcttaaatccacacacgtgtcgacacgatgacctgggtgccggaggccttgatgccgctggttggtcattgggatacgtggaggccaaacccgacttattaaggaactatcatgtcccaagtcaacatgcgcgatatgctgaaggccggtgtgcacttcggtcaccagacccgttactggaacccgaaaatgggtaagtacattttcggcgcgcgtaacaagatccacattatcaaccttgaaaaaaccctgccaatgttcaacgaagcgctgactttcgtagagcgcctggcccagggcaaaaacaagatcctgttcgtcggcaccaagcgttccgctggcaagatcgttgctgaagaagcagcacgttgcggttcgccgtacgtcgatcaccgctggttgggcggcatgctgaccaacttcaaaaccatccgtgcttccatcaagcgtctgcgtgaccttgaagtgcaggccgaagacggtactttcgccaagctgaccaagaaagaagcgctgatgcgcactcgtgacctggaaaagctcgatcgttccctgggtggtatcaaggacatgggcggtctgcctgacgcactgttcgttatcgacgttgatcacgagcgcatcgcgatcaccgaagccaacaagctgggcatcccggttatcggcgtagtcgataccaacagcagcccggaaggcgttgactacatcatcccaggcaacgatgacgcaatccgcgctatccagctgtacatgggttcgatggctgacgctgtaatccgtggccgcaaccacgttgctggtggtaccgagcagttcgttgaagaagctccggtagctgccgctgagtaactgacgccctggcgttgactcagtaagcaaaaagggggcttggccccctttttgccacctcgaaaaccatttgtcggcagcgcagctacattctttgtaacgtgcagcggcctacaacggagattcgggaagaattgatcgcccgtttgatcgggtggaatggttgaaaacctatccaagaggattttgaaatggcagagattactgcagcgttggttaaagaactgcgtgagcgtaccggcgaaggcatgatggattgcaaaaaggccttgaccaaggccggcggcgacatcgaaaaagccattgatgacatgcgtgcttccggcgccatcaaggctgccaagaaagcaggcaacgtcgctgctgaaggcgccatcgccctgaaggaagacggtaaatccgccgttctgctggaagtgaactcgcagaccgacttcctggccctgcaggatgacttcaaggcattcgttgctgccagcgtcgagaaagccttcgctgacaagctgaccaccgttgagcctctgatcgaagctcaagaagctgatcgcctggtactggtcggcaaggttggcgaaaacgtcaacatccgtcgcctggttcgcgttgaaggtgatgtcgttggtggttacctgcacggcaacaagatcggtgtagcggttgttctgaaaggcggcgacgttgagctggccaaagatatcgcgatgcacgttgcagccagcaaccctgagttcctgctgccttcggaagtttctgccgaagcgatcgagcgcgaaaaagcggtattcctgcagctgaacgaagaaaaaatcaaaggcaagccagaaaacattgttgagaatatggtcaagggccgtatcagcaagttcctggctgaagcaagcctggttgaacaggcgttcgtcaagaaccctgaaatcaaggtgggcgaactggccaagaaagccggtgctgaaatcgtttccttcacttacttcaaagtaggcgaaggcatcgataagccggtcgacaacttcgctgaagaagttgctgcccagctggctgccgccaagcaataagacagttccagactgtcgccgaaagaggctgcccgctcacgcgcgcagcctcttttcaaatgggaaggccaattttatttggtttcctctcggaactggcttacaaagccgtgttccgatggcgctgtgatagcgtccagctagagtgaacgcaagccgtaaacggctcgccaagaattttttaaaaaaatacgccgcaggagagattcgcaatggctcagcagggcagtggttatcaggctcgctataaacgcattctactcaagctcagcggcgaggccctgatgggctcggaagagttcgggatcgaccccaaggtgcttgaccgcatggcgctggaagtcggccagctggtcggtatcggcgtgcaggtcggcctggtgattggtggtggcaacctgttccgtggtgcggcactgagtgcggctggcatggatcgggtcaccggcgaccacatgggcatgctggccactgtgatgaacgccctggccatgcgcgacgccctggagcgcgccaacatctcggccatcgtgatgtcggctatttccatggttggcgtgactgatcattatgatcgacgcaaagccatgcgccacctgaattccaaggaagtggtgatcttcgctgccggcactggtaacccattctttaccaccgactcggctgcgtgcctgcgcgcgatcgaaatcgatgccgacgtggtgctcaaggcgaccaaggtagacggcgtatacactgcagacccattcaaagacccgcatgccgagaagttcgatcatctgacctacgatgaagtgctggatcgcaagctgggcgtgatggacctgacggctatctgcctgtgccgcgaccacaagatgccgttgcgcgtatttaacatgaacaagcccggcgccctgctgaatatcgtacacggcggcgcagaagggactctgatcgaggaaggccaacaatgatcaatgaaatcaagaaagacgcccaggcgcgtatgcagaaatccctggaatccctgagccacgcatttggccagatccgtaccggcaaggcgcacccgagcatcctgggcagcgtgatggtgccttactacggcgctgacactcccctgagcagcgtggccaacgtcaccgtgaaggactcgcgtaccctgcaagttgtggctttcgagcgcaacatgcttgctgctgtagacaaagcgatccagagcgccggcctgaacctcaacccgaccaacctgggcgagttgttgctgatctccatgcctgccctgaccgaggaaacccgtaaaggcttcaccaagcaggcacgcagtgccgctgaagatgcgcgcgttgccgtgcgcaacatccgccgtgatgcattgggtgacctgaagaagctggtcaaggacaaggaaatcagcgaagacgaagagcgtcgtgccgtcgctgatatcgacaagctgaccaaggacgccgaagcgcagatcaccaaggcgaccgaagaaaaagaaaaggacctgatggccgtataaggggtcaggacgccttcatggaaaagaccaagcagactgtgccctccgtggtgccgcgccatgtcgcgatcatcatggacgggaataatcgctgggcgaaaaaacgctttatgccgggtgttgccgggcataaagcgggtgttgacgcggtaagggcagtgattgaggtgtgcgctgaggccaaggtcgaagtgttgaccttgttcgccttctccagtgaaaactggcagcggcccgccgatgaagtcagcgccttgatggacctgttcttcaaggcgctgcgtcgtgaggccaagcgcctcaatgacaacaacatcagtctgcgcatcattggtgatcgctcgcggttccacccggaactgcaagccgccatgcgcgaagccgaggctattaccgcaggcagtaaccgctttgtgctgcagatcgcagccaactacggtggccagtgggatatcgcccaggcagcgcaacggctggcccgcgaagtgcaggccggtcacctgcgaccggacgacatcacgcctgaactgttgcaaacctgcctggtgactggcgacttgccgttgccggacttgtgcattcgtaccggtggcgagcatcgcatcagcaatttcctgctgtggcagctggcatacaccgagttgtacttctccgacctgttctggccggacttcaaacacgatgccatgcgtaatgcgctggctgatttcgcttcccgtcagcgtcgcttcggtaaaacgagcgagcagatcgaagctggagcccgggtttaaatgttaaaacaacgaatcatcacggcgctgatcctgctgccgattgccttgtgtggttttttcctgcttgaaggttccggctttgcgctgtttatcggcctggtcgtgacgctgggagcctgggagtgggcgcgcctggcgggtttcagcggccaattgccgcgtatggcgtatgcggcagtggtcgcagtgctgttgttcctgatgtacatcctgccggacattgcgccttgggtgctgggcgcggcagtgctgtggtgggcgttggcgacattcctggtgctgacttacccgcgcaccagtggccagtggtcgagcgtggcctgcaagctggtgattggcctgctgatcctgctgccggcctggcaagggctggtggaaatcaagcgttaccccctcggtaacgaattgatcctggcggtgatggtgctggtgtggggcgcagacattggcgcctacttctccggccgtgccttcggcaagcgcaagctggccccggccgtcagccccggcaagagctgggaaggcgtgtatggcggcttggcgttgacgctgctgatcacgctggtagtcggtatggtacgcggctggtcggtgaaggagattttcatggccttgctgggcacggctatcgtcgtgttcatctcggtggtgggtgacctcaccgaaagcatgttcaaacgccaggccggcattaaggacagcagtaacctgctgccagggcatggtggtgtgctggatcgtatcgacagcctgactgccgcgctgccgatcttcgctgtgctgctgtggatgatcgcttcgtgagccgcctgcaacaggtcaccgtgctgggggcgaccggctcggtcgggctgagtaccctggacgtcattgcccgtcatcctgatcgctatcaggttttcgccctgaccggcttcacgcgcttgagtgagttgctggccttgtgtgtgcgccatgcgccgcgctttgccgtggtgcctgaggcggcggcagcccgtagcttgcaggatgatctgcgggctgccgggctggacacccaggtcctggtgggtgaggcggggctgtgccaggtgtcagccgatgcgcaggtggataccgtcgtggcggcgattgtcggtgcggcgggtttacgcccgaccctcgctgcagtcgatgccggcaagaagattctgttggccaataaggaagccttggtcatgtccggggcgctcttcatgcaggcggtgcgcaagagcggtgcggtgctgctgccactcgacagcgagcacaacgcaattttccagtgcatgcccggggattttgcccgcggtttgaaccaggtcggcgtgcgccggattctactgacggcgtctggtggtccattccggcagactccgttggccgagctggaacatgtgtctcccgatcaggcctgcgctcacccgaactggtccatggggcgcaaaatctccgtggattcggcaagcatgatgaacaagggcctggagttgatcgaggcgtgctggttgttcgatgcgcggcctgaccaggtcgaggtggtgattcacccgcaaagcgtgatccattccctggtcgattacgtggacggttcggtgttggcgcagctgggtaatccggatatgcgtacaccgatcgccaacgccttggcctggccgcagcggattgattccggcgtagcgccattggatctgtttgcggtggcgcgcctggacttcgaagcgccggacgagcagcgcttcccatgcctgcgcctggctcggcaggcggccgaggcgggcggcaccgcgccggcgatgctgaatgcggccaatgaagtggccgtggcggcgtttctcgaacggcgcatccgctttccgcagatcgcgagtatcatcgaggacgtcctgggccttgagcctgtcgtggcggtgaatgacctgggggccgtgtttgaggcggataccaaggcgcgagccctggccggacaatggctgggccgcaatacgcgttaggctgtgggttcgagccttcaggcattggattgaaatgcggagaaattagatgagtgcgctctacatgattgtcggcaccctggttgctctgggtgtgctggttaccttccacgaatttggccacttttgggtggcgcgtcgttgcggcgtcaaggtattgcgcttttccgtcggtttcggcatgcctttgttgcgctggcatgatcgccgtggcaccgagtttgtgatcgccgctatcccgctgggtggctacgtcaagatgctcgatgagcgtgaaggcgaagtgcccgctgatcagttggaccaatcgttcaatcgcaagaccgttcgtcagcgtatcgcgattgtcgctgcgggcccgattgccaacttcctgttggcgatggtgttcttctgggtactggccatgatgggcagccagcaggtgcgtccggtcatcggcgcggtcgaggcggacagcatcgcggccaaggccggcctcatcgcagggcaggaaattgtttccattgatggcgagccaaccacgggttggggcgcggtcaatttgcagttggtgcgtcgcctgggtgaaagcggcaccgtcagtgtggtggtgcgtgaccaggattccagcgccgaaaccccgcgggcattggcgctggatcattggctcaaaggggccgacgagccggatccgatcaaatccctggggattcgcccttggcgcccggcattgccgccggtgctggctgagctcgatccgaaaggcccggcccaggccgcgggcctgaaaaccggtgatcgtctgttggccctcgatggccaggcgctgggtgactggcagcaagtggtcgacctggtgcgtgtacgccctgataccaggatcgtgctgaaagttgagcgagagggtgctcaaatcgatgtgcctgtgaccttgtcggttcgtggcgaggccaaggcggccggggggtacctgggggccggcgtcaaaggtgtcgagtggccgccatcgatggtacgagaggtcagcttcgggcctttggccgcgattggcgagggcgcgaaacgcacctggaccatgagcgtgctgaccctcgaatcgctcaagaaaatgttgttcggtgagctctcggtaaaaaacttgagtggaccgataaccattgctaaagtggcgggcgcttctgcccagtcgggtgtcgcggatttcctgaatttcctggcttatctgagtattagcctgggggttctgaatttgctgcccattccagtattggatggggggcatctgttgttttatctggtcgagtgggtgcgtggtcgccccttgtcggatcgggtgcagggttgggggatacagatcggtatcagtttggtggtcggagtgatgttgttagctctggtcaacgatctgggacgactgtaacgcttcgctgaattgcgaatctgccgcattttgcggcagtttgtttattgccagttggaataagaaaggacttcatgaaacgtctgctgctaactgcggttctcaccgtattgatgatcgccgaagttcacgccgagtccttcactatctccgatattcgtgtcaacggcctccagcgggtatccgccggtagcgtctttggtgccttgccgttgaacgtcggggaacaggcggatgatcgtcgcctggtggaatccactcgtgcgctgttcaaaaccgggttctttcaagatatccagctgggtcgcgaaggcaacgtcctggttatcacggtcgtcgagcgaccttccgtcgccagtatcgcgattgagggtaacaaggccatctccactgaagacctgatgaagggcctcaagcaatccggcctggccgagggcgagatcttccagcgcgctacccttgagggtgtgcgtaacgagctgcaacgccagtacgttgcccagggccgctactccgcgaccgtggaaaccgaagtgatcccgcagcctcgtaaccgtgtgggcctgaaggtcaacatcaacgaaggcaccgtggcggccatccagcacatcaacgtggtgggcaacaccaagttcgctgatgacgacctggtcgacctgttcgaactcaagaccaccaactggctgtcgttcttcaagaacgatgacaagtacgcccgtgaaaaactctccggtgacctggaacgcctgcgctcctactacctggaccgtggctacatcaacatggatatcgcttcgacccaggtgtccatcactccggacaaaaagcacgtctatatcaccgtcaacgtcaacgaaggcgagaagtacaaggttcgtgacgtcaagctcagcggcgacctgaaagtccctgaagaccaggtcaagtccctgctgctggtgcagaaggaccaggtgttctcgcgcaagctgatgaccaccacctccgaactgatcacccgtcgccttggtaacgaaggctataccttcgccaacgtcaacggcgtgccgaccccgaatgatgaagaccacaccgtggacatcactttcgtcgtcgacccgggcaagcgtgcctacgtcaaccgcatcaacttccgcggcaacaccaagtctgccgacgaagtgctgcgtcgtgagatgcgccagatggaaggtggctgggcttcgacctacctgatcgaccagtccaagacccgtcttgagcgcctgggcttcttcaaggaagtcaacgtcgaaactccggccgtaccgggtgtggatgaccaggttgacgtgaactacgccgttgaagaacaagcctcgggttcgatcaccgccagcgtcggttttgcacagagtgccggcctgatcctcggtggctcgatcacccagaacaacttcctcggtaccggtaacaaggtgtccatcggcctgacccgcagcgaataccagagccgctataacttcggttatgtcgacccctactggactgctgacggtgtgagcctgggctacaacgccttctaccgcaccaccgactacaaagacctcgacgttgacgttgcaagctatgcgatcgacagcctgggtgtgggcgccaacatcggttacccgatcagcgagacctcgcgcctgacctttggcatcactgcgcaacaggatgagatcaagaccggtgtgtacaccgtggacgagatctttgacttcacccgtcgtgaaggcgacaagttcctgaacttcaaggcgtctgccggctggtccgagtcgaccctgaacaaaggtgtgctggcaacccgtggtcattcccaaagcctgactgcagaagtcaccacgccgggcagcgacctgtcgttcttcaagctcgattaccgcggccagctgttccagccgttgagcgataactacaccatgcgcctgcacactgagctgggctatggcgacggttacggttccactgatggcttgccgttctatgaaaactactacgccggtggtttcaactcggtgcgtggcttcaaggacagtacgttgggcccgcgtggtaccccgagccgcggtgttgaacaaaccggtaacgccggaacgcgacgtgacgacgacaacgacccgctgccattcggtggtaacgtgctgatccagggtggtgcagagatcctgttcccgctgccattcgtcaaggaccagcgttcgctgcgcacctcggtcttctgggacgtgggtaacgtgttcgactccaagtgtgaacaagtcaccaacccgaacggttcgcggtccaacacccaatgcaacgacgtgagcctcagcaacctggcgagctccgtgggcgtgggtgtgacctgggtgacggcgctgggcccgttgagctttgctctggccatgccgatcaagaaaccggataacgctgaaacccagattttccaattctccctcggccagacgttctaagcgtctgacctaagataacgacaacggattctgtaggagtacatcgtgcgtaagttgactcaattggtcctgctggccactgtgctggtaaccaccccggccttcgccgaaatgaaaatcgccgtgctgaactatcagatggccctgctggaatccgatgcggccaagaagtacgccgtggatgccgagaagaagttcggtccgcaactgaccaagctcaagacgttggaaagcagcgccaagggcatccaggatcgcctggtagctggtggcgacaagatgcagcaaggcgagcgcgagcgtctggagcttgaattcaagcaaaaggcccgtgactaccagttccagtccaaggaactgaacgaagccaaggccgtggctgaccgtgagatgctcaagcagctcaagcccaagctcgacagcgccgtggaagaagtcatcaagaagggtgccttcgacctggtgttcgagcgcggcgccgtgattgacgtcaagcctcaatacgacatcacccgccaggtgatcgagcgcatgaaccagctgaagtaacccatgactgcgactatcaagctcggcgagttggccgagttcctgggagccaccttgcgtggctccccggagaaagaaattactgggctagccaccttgcaggaggctggcccagctcagttgagcttccttgcaaacccccaataccgtaagtacctggtcgattgccaggccgcagccgtgttgctgaaggccgctgacgccgaagggtttatcggggatgcgctggtggtggccgacccgtacctgtcgtacgccaaggcgtcacacctgttcgatcccaagccgaaagcggctggcggtattcatccgtctgccgtgatcgccgatgatgcccaggttgatcctgcggccagcattggtgcgttcgccgtgatcgagagtggtgcgcgtatcggtgcaggcgtgaccgtgggcgcccactgctttatcggtgcgcgctgcgaaatcggcgccgatggctggctggccccccgtgtgaccctctaccacgatgtgcgtattggtcagcgtgtggtcattcagtcgggggcggtgatcggtggtgaagggttcggttttgccaactccaagggtgtctggcacaagatcgcccaggtcggcggcgtattgatcggcgacgatgtggagatcggcgtgaacaccgctgttgatcgcggggccctggccgataccgtgatcggcaacggcgtgaagctcgataaccagatccagatcgcccacaacgtacagattggcgatcacaccgccatggctgcctgcgtgggcatctccggcagcaccaggattggcaagcattgcatgctcgccggtggtgtcgggctggtcgggcatatcgacatttgcgacaacgtcttcatcaccggcatgaccatggtgacccactcgattaccgagcctggtgcctattcttccggtaccgccatgcaacctgcggctgaatggcgcaagagtgcggcgcggttgaggaagatcgacgacatggcacgacgcatcaaacagctggaaaagcgtgttggggacgtgacccctggcggtaatgcttcatcagaaggctgataccatttccatatcaagtgtgcacagccgctagactgcccccttgatttgctagcggggcgtgcgcttagtccgcccgcccccaatctttattacaggcttccccccgaaatgatggacatcaacgagattcgcgaatacctgcctcaccgttacccgttcctgctggtggatcgtgtagtggacctcaacgtcgaggaaaagcgcattcgtgcctacaagaatgtcagcatcaacgaaccattcttcaacggtcactttcctgcgcatccaatcatgccgggtgtgttgatcatcgaggcgatggcccaggctgccggtatccttggttttaaaatgctcgacctcaagcctgccgatggcacgctttactatttcgtgggttccgacaaactgcgttttcgcagcccggtcactccgggtgaccagttgatcctggaagccaagttcatcagctgcaagcgccagatctggaagttcgaatgccaggcctcggtcgatggcaagccagtgtgctctgccgagatcatctgtgcggaacgcaaactatgagtttgattgaccctcgcgcaatcatcgatccgtcggccgtactggccgccgacgttgaggtcggcccttggtcgatcgtcggcgcaggtgtggaaatcggcgaggggactgtcatcgggccgcatgtgatcctcaagggtccgacccgcattggcaaacacaatcgtatctaccagttttcctcggtaggtgaagacaccccggacatgaagtacaagggtgaagaaacacgcctggtaatcggtgaccacaacatcatccgtgaaggcgtcaccattcaccgcgggactgtgcaggatcgtgccgaaaccaccttgggtgatcacaacctcgtcatggcctatgcgcatatcggccatgacagcgtgatcggcaaccattgcatcctggtcaataacaccgcgctggcaggccacgtgcacgttgacgactgggcgatcctgtccggattcacccttgtgcatcagtattgccatatcggcgcccacagcttctccggcatgggcactgctatcggcaaggatgtcccggcattcgttacggtgttcggcaatcctgccgaagcccgtagcatgaacttcgaaggcatgcgccgccggggtttgagcgaggatgcgatccacgccctgcgccgcgcctacaagaccgtttaccgccaaggattgacggttgagcaggcccttaccgaactgaccgagccggctacgctgttcccggaagtcgcggtgttccgtgactcgatccaggcgtcgactcgcggcatcacccgctgatcatggccaacctgcgtattgcgctagtggccggtgaagcttccggcgatatcctgggtgctggcctgatgcgtgccctcaaggcccagcatcccgcggtggaatttatcggggtgggtggccctttgatgcaggccgaaggtcttgcttcctattttcccatggagcgtctgtcggtcatgggtctggtggaggtattgggacgcctgcgcgagcttctcgctcgtcgcaaactgctggtcaagacactcatcgaagaaaagcccgatgtgtttatcggtatcgatgcgccggatttcaccctcaatatcgaactcaagctgcgtcaggctggaatcaagaccgtgcactacgtcagcccgtccgtgtgggcgtggcgacagaagcgcgtgttgaagatccgtgaaggctgcgatctgatgttgaccctgttgccattcgaggcgcggttctacgaagagcagggcgtgccggtgcgttttgtcggtcataccttggcagatgccatccccctgcacgctgaccgtgctgcggcgcgtgccgcattgggcttgcccgatggcccattggtggcgttgatgccgggcagtcgtggcggtgaggtcgggcgcttgggtgcgctgttttttgacgccgccgaacgtctgcaagcgcaaaaaccgggcgttcgttttgtattgccatgcgccagcccgcaacgtcgcgcgcagatcgaaaccttgctggaaggccgcgacctgccgctgaccctgctcgacggccagtcccacctggccctggcagcctgcgatgccgtgctgatcgcgtcgggtactgccaccctggaggccttgctgtacaagcgccccatggtcgtagcctatcgcctggcgccgctgaccttctggatcctcaagcgcatggtcaagagcccctacatctctctgcccaacctgctggcccagcgcctgctggtgccggagttattgcaggacgatgcaacgcctgaggcgcttgcgcaaactctactacccttgatcgacggcggcgaagagcagacccgtggtttcgatgacattcaccgtaccctgcgtcgtgatgcctcgaaccaggcggccgacgccgtgttgaccttgatcggccaaaaacagggagccttatgatcacgcaaatgggcctggatttcagcctggttgcccaagcccatgagctggtggccggcgttgacgaagtagggcgcggtccgctgtgcggtgcagtggtcacggcggcggtgatccttgacccgaaccgtccgatcctgggcctcaatgattcgaaaaaactcactgaagcccgtcgtgaaaaactcttcgacgagatctgtgagaaagccctgagctggcatattgcccgggcagaagtagaagaaatcgacgaattgaacatcctgcacgctactatgctggccatgcagcgtgcggtggaaggcctgcatatcaccccgaaattggcgatgatcgacggcaaccgttgcccgaaactggcgatgcgcgctgaagccgtggtccagggcgatggcaaggttccggccattgctgcggcgtcgatcctggccaaggtcagtcgtgatcgcgaaatggctgcgttcgatttgatctaccccggctatggcatgggtgggcataagggctatccgacacccgttcatctggaagccctggcccgcctcggcccaacgcctatccatcgtcgctcctttgccccggtgcgccaggcttatgaggcgcgtgagagcctgatcgaggtttagcggcaaggctgatgtttttaccaaggcccggtacaatccgggccttgttgttttcatgtatcaagacaggatcactatgccggcttcattcgttcacctgcgcctgcacactgaatactccctggtcgacggcctggtacggatcaagccactggtcaaaaccctggtgggcatgaacatgcctgcggtggcggttaccgatcagaacaacatgtgctccctggtcaagttctacaagaatgccatgggcgccggcatcaagccgatctgcggtgtcgacctgtggctgtccaacaaagacccggataacccccttagccgcatcagcctgctggcgatgaacggcgtgggttatcgcaaccttaccgaactgatttcccgtggttttatcgacggccagcgcaacggctcgattattatcgagcgcgagtgggtggccgaagccagcgaaggcgtgatcatgctctcggcggccaaggaaggtgaaatcggtatcgcgctgctgggcggtaatccccaggaagccgaagtgctggcccgcgaatggatgcaggtttttccggaccgcttctacctggaagtccaacgtaccaaccgccccaatgatgaagagcacctgcacgccgccgtggccctggccgacaagctgggcgcgccgctggtggcgaccaacgatgtgcgctttatcaagaaagaagatttcgaggcccacgaaacccgcgtgtgcatcggcgaaggtcgggccctggatgacccgcgccgctcgaaaaactacagcgaagagcagtacctcaaaagcgccgaagaaatggcggagttgttcagcgatttgcccgaggccctggaaaactccgtcgagatcgccaaacgctgcaacattgaagtgaagctgggcaagcacttcctgcccaacttcccgattcccgatggcatgaccatcgatgagtacttccgcaaggtgtcgttcgatggcctggaggagcgcctcagcgtgctgctgcccaaagacaccaccgaagactatgaagccaagcgtcaggtgtatgtcgaccggttgaatttcgagctggatatcatcatccagatggggttcccgggctacttcctgatcgtgatggactttatccagtgggccaagaacaacggcgtgccggtcggtccgggccgggggtcaggtgctggctccctggtggcctatgtgcagaagattaccgacctcgacccgctggaatatgacctgctgttcgaacggttcctgaacccggaacgggtatccatgcccgacttcgatgtcgacttctgcatggacggtcgcgaccgggtcatcgagtacgtggccgagaaatacggccgcaacgcggtaagccagatcatcaccttcggttccatggccgccaaggcggtaatccgtgacgtggcgcgggtgcaaggcaagtcctacggtttggcggatcgcctgtcgaagatgatcccgttcgaagtcggcatgaccctggaaaaagcctacgaacaggaagagatcctgcgcgacttcatcaaggtcgatgaagaagccgcggaaatctgggagatggcgcgcaagcttgaaggcgtggtgcgtaacgtcggtaagcacgccggtggtgtggtgatcgcgccgaccaagctgaccgacttttcgccgatctattgcgatgaagaaggcgacggcctggtgacccagttcgacaaggatgacgtggaggcggccggcctggtgaagttcgacttcctcggcctgcgcaccctgaccatcatcgactgggcgctcaagaccatcaaccgcgaccgtgccaaggtcggcgaagaaccgctggacatcgcgtttatcccgctggacgacaagccgacctacagcctgttgcaaaaagccgaaaccacggcggtgttccagcttgaatcccggggcatgaaggagctgatcaaaaagctcaagcccgactgcctggaagacttgatcgcactggtggccctgttccgtccgggcccgctgcaatcgggcatggtggatgacttcatcaaccgtaagcacggccgcgccgaactggcatacccgcactccgactaccagtacgagggcctcaagcccgtattggcgccgacctacggcatcatcctgtaccaggaacaggtgatgcagatcgcccaggtgatggcgggctacacccttggtggtgcggacatgctgcgtcgcgccatgggtaagaaaaagcccgaggaaatggccaagcagcgtggcggtttcattgaaggctgcgcaactaacaatatcgacgccgacctggcgggtaacatcttcgatctagtggagaagttcgccggttatggcttcaacaaatcccactccgccgcctacggtctggtgtcgtaccagaccgcctggctgaaagcccactatccagcgccgttcatggcggcagtactctcggcggatatgcacaacaccgacaaggtcgtgaccttgatcgaggaagtgcgcaccatgaagctgcgcctcgacgcgccggacgtgaacgcctcggagttcaagttcacggtgaatgacgaaggccgcatcatttatggcctcggcgcgatcaagggcgtgggcgaaggcccggtggaagccatcaccgaggcgcgccaggacgggccgttcaaggacctgttcgatttttgcgcacgggttgacctcaagcgcatcaacaaacgtaccctcgatggcttgatccgcagcggcgcactcgaccggctcggcccgtatttccatgatgagccgaaggcttaccaggccaatatcgaccgcaaccgcgcggtgctgctcaccgccatggaagaggcgatcaaggctgccgaacagaccgcacgtacccatgacagcggtcacgccgacctgtttggcgggctgtttgtcgaagaagatgccgatgtctacgccaaccatcgcaaggccaaggagctgaccctcaaggagcgtctcaagggtgagaaagataccttgggcctgtacctcaccggtcacccgattgacgagtacgaaggcgagatccgacgtttcgcccgccagcgcatcatcgacctgaaaccggcgcgcgatacccagaccgtcgccggcatgattatcgccctgcgggtgatgaaaaataagaagggcgacaagatgggctttatcaccctggacgaccgctcgggccgtatcgaggcgtcgctgtttgccgacgccttccactccgcccagtcgctgctgcagaccgacgccatggtggtagtggaaggggaggtcagcaacgacgacttctccggcggcctgcgcctgcgtatcaagcgggtgatgagtatggaagatgcccgtaccaacctcgccgaaagcctgcgcttgaaggtcaagaccgaagcgctcaagggcgatcagctacgctggttgggtgacctgctcaaacgccaccgtggcgcgtgcccggtgaccatggagtacaccggcaatgacgccaaggccatgttgcagtttggcgagacgtggcgaattgatcccgccgatggcttgattcaagctttgcgtgaccagttcgggcgagacaacgtcttcctccaataccgttgacggtcagtacccctgacctcggctgaacatttaatctcgacctaaacgcgcctctcccttaaggtagggcgcgaatagacaaccggctggccaggcaccccttggccgtcgacccaagacggacgcttatgaacccgaattttcttgatttcgaacagccgatcgctgacctgcaagccaagatcgaagagctgcgcctggtcggcaatgacaattcgctgaatatcggcgatgagatcgctcgcctgcaagacaagagcagcacgctcaccgaagacattttcggcaagctgaccagctggcagatcgcgcgcctggctcgccacccgcgccgtccgtacaccctggactacatcgagcacatcttcaccgagttcgacgagctgcacggcgaccgacatttttccgatgacgcagccatcgtaggcggtatcgctcgcctggacgaccagccagtgatggtgatcggtcaccagaaaggccgtgaagtgcgcgagaaggtgcgccgcaacttcggcatgccgcgcccggaaggctaccgcaaggcgtgccgcctgatggaaatggccgagcgcttcaagatgccgatcctgactttcatcgacaccccgggcgcctacccgggtatcgatgccgaggagcgtaaccagagcgaagcgattgcctggaacctgcgggtcatggcgcgcctgaaaaccccgatcatcgccaccgtgatcggtgagggtgggtccggcggtgcactggccatcggcgtctgcgaccagctgaacatgctgcaatactcgacctacgcggtgatctcaccggaaggttgcgcctcgatcctgtggaaaaccgcagagaaggcgccggatgcggctgaagccatgggcatcaccgctgatcgcctcaagggcctggggattgtggataaagtcattgccgagccactgggcggcgctcaccgcgacccggctgcggccgccgcgaccatccgtgctgaactgggctcgcaattggcgatgctcaagaagctggataacgaagcgctgctggcccgtcgttacgaacgccttatgagctacggtctctaaagtcgcagcagtactaatgtgggagggggcttgctcccgattgctgggtgtcagtcactgtatctgctgactgatccaccgctatcgggggcaagccccctcccacatttgctttgtgtatgctcagcctacgtattccagatttgtggcggtgacatctgatgaaaccggctctacccgccagactcctgaaaaccctggccccctggcgcaatgcccccgcctggcatatcgcattctccggtggcctcgattccaccgtcctgctgcaccttctggcctccctggcaaacaccgaaaacctgccgcccctcagcgctgtgcatgtccatcatggcctgcaaacggccgctgacgcctggcccagtcattgccacgagttatgtgacagcctgggcatacctttgcaggtattgcgtgtacaggtgcaacccggtgccagcctggagcgggccgcgcgtaacgcacgttaccaggcgtttaccgaagtgatcggggcaggggaggtgctgctcaccgcccagcatcgcgacgatcaggccgaaaccctgctgttgcgcctgttgcgcggcgccggagtgcgtgggttggcggcaatgcccgagtgtcgccggttggcgacggggtacgtggtgcggccattgctggcggtttcccgcggagtgctggaagcctacgcccacgaacaccaattgaagtggattgaagacccttcgaacgccgatccacggttctcgcgcaattacctgcgccatcaggtctttccagcgctgacccaacgctggccacaggcagccttgagcctggcccgcactgccgagcacctgagtgaagcccagggcctgctcgatgagctggcgcacatggatctgatcgtcgccgatcagccttcagcgtttccctggttgcctttgccctccctggcccttgctccgttacgcaagctttccgatgcgcgccagcgcaatgccttgcgtcattggctgaatcccctgactcgactgcccgacagtgaccactgggccagctggtacgccctgcgcgatgccaaggtggacgcgcagccgttatggcgcctggcggacggtcagcttcatcgttgcggcgaacgcatttggtggctgccttccatttggtcggaattttccgacgtgtcggtgagctggcccgatccgcgaaatccactagagttacccgggaacggccaactgatgtttgtcggcaaggctcccgagggccctttgtcgattcgttatcgccagggtggcgaaatcgtcgaagtgccaggtcgaggccggcgtgatcttaagcgcctgctgaatgaaagtggtatgccgggcttcgtccgtggcagattgccgctggtccatcggggcgagcaattgctggctgtgccgacgcttgcggggctgtgggccagcccgctggatgactggcaattacattggttgccacagacctgcgatcaaggtttgagctgatagagcctttccggtagactacgctcccttcttgatacaacttctgtggattcgactgaatcgcagcagttgccgattaccaagcagtctttgctgggcgattccaaaaaatgtgtagcgatcaacgtaccggtgttccatcgctggtctgtcacaacgcggcggtttttttgaaaggtgcactgtgattaatgcaggtgatcgggggcttcggccttccttcgctttccccggcggctcggaccgctttaacgcagacttctagggtttttcatgacgcgctacatattcgtcacgggcggtgttgtttcttcattggggaaaggcattgcctccgcttcattggcggccatcctggaggcgcggggacttaaggtcaccatgctcaagctggacccgtacatcaacgttgacccgggcaccatgagcccgttccagcacggtgaagtgttcgtcacccacgacggcgccgagaccgacctggacctgggccactacgagcggttcatccgcacgaccatgacccagaacaacaacttcaccaccggccgtgtctacgagcacgtgctgcgcaaggagcgccgtggtgactacctgggtgcaaccatccaggtgatcccgcacatcaccgacgaaatcaagcgccgcatcatcaagggtgcaggcgatgccgacgtggcgatggtcgagatcggtggcaccgtgggtgacatcgaatcccaaccgttcctcgaagccatccgccagttgcgtttcgaagttggcgccaagcgtgcgatgctgatgcacctgacactggtgccgtacatcgccaccgccggcgaaaccaagaccaagcccacccagcactcggtcaaggaactgcgttccatcggcctgcagcctgacgtgctggtgtgccgctccgatcacccgatcgacatttcctcgcgccgcaagatcgcgcaattcaccaacgttgaagaacgtgcggtgatcgccctcgaagacgccgacaccatctacaagatcccgggcatcctgcattcacagggcctggatgattttgtggtcgagcgtttcggcctgcagtgcaatggcgcggacctgtccgagtgggaagccgtggtcgacgccaagctcaaccctgagcatgaagtcaccatcgccatggtcggcaagtacatggagttgctggatgcgtacaagtcgctgatcgaagcgatgagccatgccggcatcagtaaccgtaccaaggtcaacctgcgctacatcgattccgaagacatcgagaatcagggcaccgcgctgctcgaaggtgtcgacgcgatcctggttcccggcggtttcggcctgcgcggcgtggaaggcaagatcactgcggtgcaatatgcccgtgagaacaaggtgccgtacctgggcatctgcctgggcatgcaagtggccgtcatcgagttcgcccgtaacgtgctgggctggaaagacgccaactccaccgagttcgatcacagcagcggccacccggtcgtgggcctgatcaccgaatgggaagacgccaccggcgcggttgaaacccgcaccgaaagctccgacctgggcggcaccatgcgccttggcgcacaggattgcctgctggaagcaggttccctggtgcacgactgctacggcaaggacgtgatcgtcgagcgtcaccgtcaccgctatgaagtgaacaacaacctgctgccgcagatcaaagaggcgggcctgaaaatttccggtcgctccggtgatggcaagctggttgaagtggtcgaggcgccggatcatccgtggttcgtggcctgccagttccaccctgagttcacctcgacgccgcgcgacggtcacccgttgttcagcggtttcgtcaaagcagcactgacgcaacatcagaagaaggcgtaaacctgatggcccagaagatcattcgcgttggcgacatcgagattgccaacgacaagcccatggtgctgttcggcggcatgaacgtactggaaagccgcgacatggcgatgcaggtctgtgaagagtacgtgcgggttacccagaaactgggtattccttatgtgttcaaggccagcttcgacaaggccaaccgttcgtccgtgacctcctatcgcggccccggccttgaagaaggcatgcggatcttccaggacatcaagcaagccttcggcgtgccgatcatcaccgacgtccacgagcctgagcaggctgccgtggtcgccgaggtgtgcgacatcatccagttgccggccttcctgtcgcgccagaccgaccttgtggtcgcgatggccaagaccggcgctgtgatcaatatcaagaaagcccagttcctcgcgccccaggaaatgaaacatatcctgagcaagtgcgtggaagcgggtaacgaccagttgatcctgtgcgagcgtggttcgagcttcggctacaacaacctcgtggtggacatgctcggtttcggcatcatgaagcagttcgaatacccggtattcttcgacgtgacccacgcgctgcaaatgcctggtggtcgctcggactcagccggcgggcgccgtgcccaggtcaccgacctggccaaggcgggcatgagccagtccctggccggcctgttccttgaagcccacccggatccggacaacgccaaatgcgatggcccatgcgccctgcgcctggacaagctggagccattcctggcccaactcaagcagttggacgagctggtcaagagttttccgacggtagagaccgcgtaactgccatttctccggtagaatttcccacgctttacgctcaggcccacgagcctgggccttgccctctgcaagcctgccccgttgttccacccttgcggtcggtcaaagatttccttcagctgcgtcgttttcgtcaactttggagtgtttacaacaatggcaaaaatcgtcgacatcaaaggtcgtgaagttctcgactcccgtggcaaccccaccgtcgaagccgacgtgcttctcgataacggcatcatcggcagcgcctgcgcaccgtccggtgcctccaccggttcgcgcgaggcgctggaactgcgtgatggcgacaagagccgttacctgggcaagggtgtactcaaggctgtagccaacatcaacggtccgattcgtgacctgttgctgggcaaggacccgctggaccagaaagccctggaccacgcgatgatcaagctcgatggcaccgaaaacaaaggcagcctgggcgccaatgcgatcctcgccgtgtccctggccgctgccaaggctgcagcccaggaccaggacctgccgttgtacgcgcacatcgccaacctgaacggtaccccgggcgtctactcgatgccggtgccgatgatgaacatcatcaacggtggcgagcacgctgataacaacgtcgacatccaggagttcatggtgcagccggtgggcgccaagtccttctccgaaggcctgcgcatgggcaccgagattttccatcacctcaaggctgtactgaaggcccgtggcctgagcactgccgtgggtgacgaaggtggtttcgcaccgaacctggcctccaacgaagatgcactgaaagtcatttccgaagccgtggccaacgccggctacaagctgggcaccgacgtaaccctggctctggactgcgctgccagcgagttctatgaagatggcaagtacaacctgtccggcgaaggccaggtgttcaactccgaaggtttcgccgaatacctcaagggcctgacccagcgctacccgatcatctcgatcgaagacggcctggacgagtccgattgggacggttggaaaatcctcaccgacaagatcggcgagaaaatccagctggtgggcgacgacctgttcgtgaccaacaccaagatcctgaaagagggcatcgacaagaagatcgccaactcgatcctgatcaagttcaaccagatcggcaccctgaccgaaaccctggaagccatccagatggccaaggctgcgggctacaccgctgtgatctcccaccgctccggcgaaactgaagactccaccattgccgacctggccgtgggcacttcggcgggccagatcaagaccggctccctgtgccgttccgatcgcgtttccaagtacaaccaattgctgcgcatcgaagagcaattggcaggtaaagccaagtacaacggtcgcggcgagtttcgcggctaagcagtaaatggtaaaaagtcggcgggttgcgtcggaaatttcacgaaagtgtgaatttcggcgctaatctgctgactgacaagcgcaagcctggtttttccaggctttgtgctatcagttgctgcaaaaggtttgcatgactgtcttttttcactggatatccggatttcgatgcgcagtcccaattggttgttcctcgtcttgctcttgttgctggctggcctgcagtaccgcctatgggtcggtaatggcagctttgcgcaggtggaagagctgacccagcaaattgccgaccagcgtgccgaaaacgaacgcctgctggagcgcaaccgtgtcctcgacgccgaagtgcttgagctgaagaaaggtaccgagaccgttgaagagcgggctcgccatgagttgggcatggtcaaggagggcgagaccctctaccagttggcccaatgaacggtgatttaccggccttctgggccgtgatccctgccgcgggcgttggtgcccgtatggctgcggaccgtcccaagcaatacctgcaattgggcgggcgcactattctcgaacacagcctcggctgtttcctcgaccatccatcgctcaagggcctggtagtcagccttgctgtggatgacccttattggccgaccctggcgtgtgccactgacccgcgtatccagcgtgcggacggtggctcggagcgctcgggctcggtgcttaatgcgctgctgcacctcaatgccctgggtgccagcgatgacgactgggtgctggtgcacgacgccgcgcggcccaacctgggccgtgatgacctcgacaaactcctgactgaactggcggatgatccggtgggcggtctgctggcggtgccggctcgcgacacactcaagcgcgtcgacaagcatggccgcgtggtggaaaccgtcgaccgcagcctgatctggcaggcttatacgccgcagatgttccgcctgggcgccttgcaccgtgccttggccgacagcctggtagcagacgccgtgatcaccgacgaagcatcggccatggaatggtccggccaggcgccgcggctggtcgaagggcgtgcggacaacatcaaggtcacccgccccgaagaccttgaatggctgcgccagcgccgggcttatcaggcctcctgaccctcagccgtagacttgctccaacccgggcaggcttttcagctcgctcaccaacgcctcaatgctgtcgaatggcttctcatcaataggccagccggcaacgctgatgaagtaccgaccctcctggttgttgatcctgaaacggcgcaggtccccgcgtcgggaccgatagtcaatgtgggtggcctcggtgagcatgaattggcccggccgtgccagcagtgtctgggccgacttcaccacccgactgtgggaagggccgggctgtggttccattgagtgctgcaagacggcaggatcgacgcgcaagaccaggttggctttgaccgtggcttctcccttgttgagacccaggctggcagtgcgccccggatcgacttcgatgcccaaggggtgggcgcccactctatcttctatccgcaagccgatgctgccggtgagttcggccaccccagggatgtccttgaaggtattggtatgggtatcgcccaccagcgcgacccatttacctggttggcgcttggaggtctggatccactggatcacctcggtggcgtaatagttcatcattcgctggcgcagggttcccgcgctgtcgcgcatatcgcgtagtacgtagctcacggtacagtcgatcggctggatcttgatcccggcgtctcgggctttggtcacgacgtttctgaatgagtaatagtggtttcggggcagtgggtagatcccgttcagaaagttcgtcagctcctcggccatgggggcgctcttggaccggtaaaatgccttcaacattggaatatgcacatctgtcagcagatgttcgaagtaaatgcgtttgacaccttggctcgcgagtagctgcatgttgtcgatcagaaaggctttgctcgattcggcgctgtggctttcgccgaccaccaggccgtcactggcacgtagcaatttttcgataatgctttgctgtgattcgttcaagctcaagcgggggagtaccggctgcaggggcgaatagggcaggtggttaaagaagatcgctgaatcctggtttaattggtttcttttctcaaagaacagtttgcggacgttactgatcgattgtgcatctatgccgaagggttcgaagtcttctgaaaatgaactggtgtcggtgagcatctgcaccagggtctcgcgcaggggcgctggcatttgataggcgatgaagaaactcgactgctcggagccgccgaacagtttgtaaacccgttgccaggcgttgcgaaatgcgccgcctccggccagcccggcacgccgccactgctggtcggcgctttgaatagcgtagagacccgtagattggatctgctcgggggcttctgggttattcacgaagagttcaaaaaagccccagtcattcggctttttgtagctcaggaaagtctggccctgtaacttgatggtctgcaagccactgggggctgccgtagcgaccagcgggcgagtttcagcctgggccgacgcgtggccctgaatgaccctgacactgatctgaccctcctctgcacgcgtggccgggccaagcacaggtcgcaacgcctcaagattgctcactcctttattgatgccgtggataaccaccgggagcgcgttcaaggcgccgaacacaatgcgctcaacggcgtggggtttgtctttaatcacgtcatcggcaccgatagccattccagtcaaacccgatgtcacgaagcaaaactccgccagcagcgccgtgcccatggtcagcgccaccgggatcgccagcaggcaggccttttccaacgcgtcaagggtgtcggccttgagtgtgtccaagggcgagacaatggtttttgccgccagctttgcaatgcgagcgcggatctgccgtgcgatatacgcaaatggattgcttctgagcgccggatacatcgggttattgatgtattgctcggggtcccagtaaccgttgtgcaacaaactgttgaaaaagccgggagggctggagggttccgggtacatggccatgccgatcagtgcttcctcgacaccactgtagagtaggccggagtcaatcgagtcgggttcaaagtggttggtcagggctttgcgctgggtggggtctttggccagtctcaccagcacattgcgcatgtccgccggggtgttgaaaccatggatgggcgaggagtttcccggaatgtacagcagggtgatctggctctggttgtcggtaatcgtgaggatgtcggtggcttcggattgatgaatacgcaacatgcgcacggacaggtttgcatcgggtgaatagggcgcctggaagtcttcgagggtcaggttgctggcgtccttgtcgatgccgatacctgccgctcgggcggccaattgccgttctgcttgggtaagcgtgaattcttcgtactgatggaggtaagccttggtgaaggcgatgcgcatcagggtcgtgtaattgtcccgatgttcgccccagaacagggtgacggccttgtcgtaggtttgttcgaagttgcttgagtcaatgaccttcctgagcacggcaggcgccatctccaattgggtggtcggatcgtagacctgaggctcgctttgccggtagagcgcctcataccgtctgggcgggatccagccggacgtaatgaactcttcgttgaacatctgcggaatgcggttatccatcaggcgcggtaattcatccacgatattgaaatacggcgcggtggtggaaaagcccgtggtgttgatcataccgccaggggcatggggcgcgttgcagatcatggcctcggtcaggctcatggattggacgatctgagcgctgtaggccgcgttggggttgtcgatgttgtattcaagggtggtcaggagcgtggtgtccgggtccactggttcctggctgaatggttgcagatgctcgcaaagcaattgggcggcgatagcgctgggcaccggaaagtcggccaggaccttacggacaaaatgattgatatgctggagttgttcggctttggacgtcatgggcttgcctggttttgcggtgggagcggctatttaccggtagccaggcaatgcacgggcggtagttgtttatgctcggtagaccgggttgtcacccaggccttctttgagaaagtccaccagtttcctgaccttcggcgacaaatgccgctgctgcggatatagcgcccacactgcggtatttggcggttggtgggcttccagcaacgacaccaacgtaccgtgttgcaaatgttccagtacgtagtaatcaggcaactggcataaccccacgccgtgcaaagccgcgtccagtaccgcttgcccgctgttgcagcgccaattgccctgaacgcgctgggaaaattcccgcccgtcctgggccagttgccagatatccgaactgccaatcaggcaattatgtcgactcagttccgacagactatgtggccgaccatagcgttcaaggtaggaaggcgatgcacacaggtacatgcgccgcggcgccaggcggcttgcaaccatgcgcgagtcttgcagtcgccccaggcggatagccaggtcgagcccttcatggaccaggtccagcgggcgattggtcagctcgatatccacgcgcaattgcggatagagcgccatgaaccgcgtgaccaagggcacgataaagcgttcgccgtacgccacggcacatgtcatgcgcaacatgcccttgggctcgctggtgaggtcgccgaccgcgcgcaaggcttcttcgcgaccgtcctgcaagcgttggcagtgctgcaggaaggtctggccggcctcggtcaacgtcaccctacgtgtgctgcggtacagcagtcgggtttgcaggcgttcttccaggcgcgcgacttgccggctgatgtgggaggacgatacccccaggcgctccgctgctgccgtgaactggctgcattcggccaccgcaacgaactcatcgatgccttcccagcggttccccagcattgtcattttccctgtacagcaataatgttttgcttttgcctggattattaatcagcgggtgatgttttacactccctctctcagtttttaacccgatggagaaacccggatgatcaagtcccgtgccgccgtagccttcgaagccaagaagccccttgagattgttgaagtggatgtcgccatgcccaaggccggcgaagtgctgttgcgggtggtggcgtccggcgtgtgccataccgatgcctatacgttgtcgggcgcagacccggaaggcattttcccgtcgatcctcggccatgaaggcggtgcagtggtggaagccatcggcgaaggcgtgacctccgtcgcagtcggcgatcatgtgatcccgctgtataccccggaatgcggcaagtgcaaattctgcctgtcgggcaagaccaacctgtgccaggccatccgttcgacccaaggcaaaggcctgatgccggatggcaccacgcgtttctcctacaagggccagccgattttccactacatgggcacctcgaccttctctgagtacaccgtactgccggaaatctccgtggccaagatttctaaagaagcaccactggaaaaagtctgcctgctcggttgcggcgtcaccaccggcatcggcgcggtgctcaacaccgccaaggtcaagccgggcgataccgtggctatcttcggtctcggcggtatcggcctgtcggctgtgattggtgcggtcaaggccaaggccgggcgcatcatcgccatcgatatcaacccggccaagttcgaaatcgccaagcaactgggcgctaccgattgcatcaacccgaaagactacgaccgcccgatccaggacgtgattgtcgacctgactgacggcggcgtggacttttccttcgagtgcatcggcaatgtgcagctgatgcgtgcggccctcgagtgctgccacaagggctggggtgaatcggtgatcatcggtgtagccggtgctggccaggagatcgccacacgtccgttccagctggtcaccgggcgcgtctggcgcggttcggcgttcggcggcgtgcgtgggcgtaccgaattgccaagctatgtggaaatggcccagaccggagaaattccgctggatacctttatcacccacaccatgggcctggaagacatcaacaaagcgtttgacctgatgcacgaaggcaagagcattcgtaccgtcatccacttctgaggtcggccatgagtctggaaaacctgtcatgccagaagagcttcggcggctggcataaacgttacaagcatcattccgacgtgctcggttgcgacatgaccttcgccgtctacctgccgccgcaagcggagcagggtggcaagttgccggtgctgtactggctgtccggcttgacctgcaccgatgaaaacttcatgcagaaggccggcgcccagcgcatggctgccgagctgggcctgatcatcgtcgcaccggataccagccctcgtggtccgggtgtaccggacgatccggacaacgcctgggacttcggcctcggtgccggtttctatctgaatgccacccaggagccctgggccaagcactaccggatgcatgactacgtggtgcaggaattgccggcattggtggaggcgcatttcccagcatcggaaaaacgcggcatcagcggtcattccatgggcgggcacggtgcgctggtgtgtgcgctgcgtaacccagggcgataccagtcggtatcggcgttttcgccgatcaccaatccgatggactgcccgtggggccagaaagccttttcccgttacctcggcgaagagcgttctaagtggcgtgaatgggacgcctgtgtgctgatcagcgaagcctcgcaaaagttggcgttgctggtggaccagggcgatcgtgacgatttcctcgaggttcagctcaagccgcaggccctggtgcaagcggccaagacagccaaccatccgttggaattgcgcctgcaacccggctacgaccacagctacttctttatcgccagcttcatcgaagaccatttgcgacatcatgctcgcgctttgctcggttaatgtgaggcaaaagtaggtagaatcacgccctgaattaattcggggcgtttttttatgcgtattggccacggctacgatgtgcaccgtttcgctgaaggcgatttcatcaccttgggcggcgtgcgcattgcacaccatcatgggttgctggcccattccgacggcgacgttgtcttgcatgccttgagcgatgccttgctcggcgcggcggcgttgggcgatatcggcaagcactttccggacaccgatcccagcttcaagggcgcggacagccgagcattgctgcgccatgtggtcgggttgatccacgccaagggctggaaggtcggcaatgtcgataacaccatcgtggcccaggcaccgaaaatggccccgcatatcgaggcgatgcgcgcactgattgccgcggacctgcaaattgaattggatcaagtcaacgtgaaagccaccaccaccgaaaagctcgggtttaccggtcgcgaagagggcatcgcggtgcactccgtcgccttgttgctgcgcgcatgaacgacctgcaactgctgggcccacgggcctacggcgaggccttgggcagcgcggtactgaaggcgacggctgaagacttccaggtggatgaggtgctggacatcccgctgaccggcgagggcgagcacctgtggctgtgggtggaaaaacgcggcttgaataccgaagaggccgcacggcgtattgccaaggccgccggcgtgccgttgcgcaccgtcagctatgccggtctcaaggatcgtcaggccctgacccgccagtggttcagcgtacagttgcccggcaaggccgatccggacctgagcggcgcggaaaacgacaccctcaagatcctcaaaaccacccgtcataagcgcaagttgcagcgtggcgcgcattcggccaatggctttaccttgcgcctgacccaactggccggcgacaccgccgccatcgacgcacgtttgcagttgattgcccagcacggcatacccaattatttcggtgcccagcgtttcggccacaacggcggcaatgtggtggatgcccgcgaatgggcagcgcgcaaggccctgccggagcaacgcaatgtgcgctcgcggctgctgtccaccgcccgtagctacttgttcaacaaagtcttggcggcgcgtgtcgccgacggctcctggcagcgtgcccaggtgggtgacctgctggcgtttaccgacagtcgcagttttttcccggccggggaggctgaatgcagcgacccgcgcctggcgatcctggacctgcatccgaccggtccgcaatggggcgaaggtgattcgccagcgacaggtcttacacatgaactggaacaatctgtcgccgccagcgaagccgacctgcgtgattggctggtgaatgcgggcatgagccaggaacgtcgcattctgcgactgcccattggcgggttgacgtggcattatcccgggcctgacattctgcaattggaattcgtcctgccggccggatgcttcgccactgtcttggtgcgcgagcttgttgatctggtgccggtggggcagacggacagcccatgcgtattctgatatcaaacgatgacggtgccaccgcacccggtcttgccgcgctctatgctgcgctgcaagattatgccgagtgcgtggtggttgcccccgaccaggacaagagcggcgccagcagttcgctgacgctccaccgtccgctgcacccgcaggtcctggccaatggctttatcagcgtgaacggtactcccaccgactgcgtgcacctggcgatcaacagcttgctggagcatcagccggacctggtggtctcgggtatcaacctgggcgccaacctgggcgatgacgtgctgtattccggcaccgtggcggcggcccttgaggggcgttttctcgggcgcaccgcgttcgctttttcctttgcctcgcggcagttggataacctgccgacggcggcctatttcgcacgcaagctggtggaggcccatggttccttggacctgccgccgcgtaccgtgctcaacgtcaatatccccaacttgcccctcgaccatatccgcggtatccagctgacgcgcctgggtcatcgtgcccgtgcgaaggcgcccttgaaggtggtcgatccgcgcggcaaggaaggctattggatcgccgcggccggtgatgccgaggatgggggcgaggggacggactttcatgcggtgatgcaaggttatgtatccattaccccgttgcagtttgatcgcaccttcagtgatgccttcagtggtctcgatggctggctggagggactgcgttgatggctcgtgaacaagacgacctgctgcgccgtggcatcggcatgacttcccagcgcacccgggagcgattgatccagcgtctttatgaagaaggcctgtccaacgcccaggtgctggaagtcatccggcgtacgccgcggcatctgtttgtcgatgaggccttggcgcaccgagcctatgaagatacggcgttgcccattggccacaaccagaccatttcccagccctacatggttgcgcgcatgagcgagctgttgctggcggcgggtccgctggacaaggtgctggagatcggtaccggttccggctaccagacggccgtgctgtcgcaactggtggaacgggtgttttcggtggagcgcatcaaggtgctgcaggaccgggccaaggagcgtctcgtcgagctgaacctgcgcaacgtggtgttccggtggggcgacggttgggaaggctggccggcgttggcgccgtacaacggtattatcgtcacagcagtggccactgatgtgccgcaagccttgctggatcaattggcacccggcgggcggctggtcatcccggtgggctccggcgaagtgcaacagttgatgcttatcatccgtgaagacgaaggtttttcccggcatgtgctgggtgccgtgcgcttcgtgccgttgctcaatggtccgctggcctgatcatttatttgcaagcagtgaattctgttggcgggtatgtgtcttacggcggggtctattgaatcaacatgcttggcgatcggtattaaacatgatgaatttttcgtttcagtcaggtgccagtgaaaggccaatgcccagttatacttgcgtcatatttcaagcctgatacaggcgttatgttcagccaccacaaagggagcggcgggtgagtctcacaggtcctgcgcagcgaatgagtaaaacaagctttcagcgactggtgcttggccttgtcttgagttccttattggcggcctgttcgagcacgccgtccggcggtgcgcgtgtcgttgaccgcaccaacgccgcaccgcaaagaccgacggtgaccaccggccaatacgtggtgcgcaaaggcgacaccctgttctcgattgccttccgctacggctgggactacaaggcactggccgcccgtaacaacattcctgtgccctataccatacatccggggcaaaccatccgtttcgatggtcgcagcggttcggcatctacggcagttgtgacaaagtctggttcctcgccatcgtcttcgagcaagaccaccgtcatcacccggccggcaggcagcgctgcgcctacggttacgagcaagtcgccacccgcgccgttgccacctgcagggcctgcgccgacaggttgggggtggccttcaaacggagtgttgattggaaaattctcttcaaacggtagtttgaataaaggcattgatatcgccggggatttgggacagcctgttttagctgcgtctgatgggacagttgtatacgccgggagtggtttgcggggctacggcgagctggtcatcatcaaacacagtgatacctacgtcagtgcctacggtcataaccgcaggctgttggttcgggaggggcagcaggtcaaggtcggacagacaattgccgaaatgggttcaacgggtacagaccgggtgaaactgcactttgagattcgccgccaagggaaacctgtagatccgctgcaattcctgccccgtcgttgataggttgcacagcctgttcctagcgtagaaggaacaggctccagcgttgccaaggataaaggcgtcgcttgagcttgaggtcgaactcaccaaaggactataacaatggctctcagtaaagaagcgccggagtttgacatcgacgatgaggttctccttgaaatggagagtttcaccgataaggaatcgatgtcgaatgatgaagggtctgcatcgccttcagttcgcaccaaatccaggaactccactgcgttaaagcaacacaagtacattgattacacgcgggcgctcgatgctacccagctgtacctcaatgaaatcggtttttcccctctgctgacccccgaagaagaagtccattttgcgcgtctgtcgcagaagggtgatccggctgggcgtaaacgcatgattgaaagcaacctgcgcctggtggtgaaaatcgcccgacgctatgtcaatcgtgggctgtcgctgctggacctgattgaggaaggcaacctgggcttgatccgggcggtggagaagttcgaccctgagcggggcttccgcttttcaacctatgccacctggtggattcgccagaccatcgaacgggcgatcatgaatcagacccgtacgatccggttgccgatccacgtggtcaaggagctcaacgtctacctgcgggcggcgcgtgagctgacgcaaaaactcgatcatgaaccttcacccgaagagatcgccaacctgctggaaaaaccggtaggcgaggtcaagcgcatgctgggtctcaatgagcgcgtgtcttcggttgatgtctcgctggggccggattcggataaaaccctgctggacaccctgacagatgatcgtccgacggatccttgcgaactgttgcaggacgatgatctttcccaaagtattgaccagtggctgtcggagctcacggacaagcagcgtgaggtggtgattcgccgcttcggcctgcgcggccatgagagcagcaccctggaagatgtgggcctggagattggcctgacccgtgaacgggtgcggcagatccaggtggagggcctcaagcgcttgcgtgagatcctggagaaaaatggcttgtcgagtgagtcgttgttccaataaagatcctgcttgagcgcttgaatgtgggagggggcttgcccccgattgcagtgaagcagtcgccagatgcatcgactgggctgccgcaatcgggagcaagccccctcccacatttttttgtgccaggcatcaggctcgcactagtgccaaatcccaggcataaaaaaaccccgcttttgagggcggggttttttcgactaagtcagtacaagttagataacttgaacttcttcagcttgcatgcctttctgaccgcgggtagcgatgaaagaaacctgttggccttctttcaggcttttgaagccgtcggattggatagctttgaagtgaacgaacaggtcgtcaccggattgtggagtgatgaagccgaagcctttttcatcgttgaaccacttaacggtaccagtttggcgattagacatggtgtatctccttggacaaagttaactgcgactcaggaaaagccctggccgagactgagtgcaaagagcaggaaaaattcttggagatggttggatcgaaattcaacatatcgtgtagagattctcagtgacacaagcagcacagtggcgccaccttaaccctttttccggaacgtgccaatggtatttccgaaggtttctctattttcgtgactggcggtggtatttaccgtcacccttggcagcgatccggggcccggccccgctggccgcggcctatagacggcagtacattcagcaagaaaacccctgcggcctttgaaccccaacgccggccccggtaagatggcccacagttttttctacctcgctattcaggacaccgccatgagcatcaaatcggacaagtggattcgccgcatggcgcaggaacacggcatgatcgagccgttcgtcgagcgccagattcgtggcgaaggcgacgagcgggtgatttcgtacggggtttccagctatggctacgacgtgcggtgcgccgatgaattcaaggtgttcaccaacatcaattcggccatcgtcgacccgaagaacttcgatgaaaagagcttcgtcgacgtcaagagcgatgtgtgcatcatcccgccaaactccttcgccctggcgcgtaccgtggagttcttccgtattccccgtgacgtgctgaccatctgcctgggtaaaagcacctacgcgcgctgcggcattatcgtcaatgtgacgccgcttgagccggaatgggaaggccatgtgaccctggagttctccaacaccacgacgttgccggcgaaaatctacgccaacgaaggtgtggcgcagatgctgttcctgcagtccgacgaagcttgcgaagtgtcctacaaagaccgcgccggcaagtatcagggccagcgtggcgttacgcttccacgcgcttgatcgaaagctcctaccggtaaagggaattagtctgcgcaaagtgactctatctaggtgtactgcctcggcgcgtgcaaaacgcgccgggccacgcttgaggagtaccttatgaagatcgatccgcgaatcagcgcagaacttgcccggcttgaacccaaccaaattggcgttctggcctggtcactgatggccaatcccgcccatgcaggcggcattccgggccagcccgaacccgattatccacagcctaccgaacccggtgagccgaccctgccagacgagccaccacctgcacctgtcgcctgatacccggatggccggtcagcacttcactgaatcggccagaccgcctgatcgccgatcacaaagattcggtggtcatcgccctgctccacggcatacccgcccgtaaatgcgccaaatgctggcagcaggctgacccgtctgccgatctggaagcacggtaggcgcagacgctggcggcctttgccgcgcaggcgatacaccgggtgcacatgccccgccagcacgtgatgggtggggtggctgtccggttcatgttgcagggcgaaagggcccatcaacagcggctcagggaccacctcgatcctcaagtccgtaggcgggtcgcccgcacgtttatcgtgattgccgcgaatcagggtcatgaccagggtcggattgcgtgcacgccaggctcggatcgcgctgagggtgccactggcgtgtgagcctggaccatggagaaagtcaccgagaaagatcaactgcgagcaaggcagggccgctaacaggttgtccagccgttgcagattggcggtggtggtgccctggggcacaggttgcccgaggctgcggtaggccgatgccttgccaaaatgcgcatcggcaaccagcaggcactgacgggctggccagtacacggccttttccgccaacaaccacagctcttcgccttccagtgtcagtgcacaatgcatcacccaattcctttgtctgcgactttctccaggtccttgaccatccgcgcaatgcgctccgagagtttttccgaactcatgctctcgcgcatgcgttctaccagcagcgggaaggccaggggcgtaggccgctggatcaggtgcagatccagcttcagcgccgataaatggcttaaggtctgctccagccgacgaatatccaactcatcgcgcagcacttcttccccggcctgggccagtagcaggttctgcgggtcatattgcttgaacacttcaaagaacagaccgctggacgcttgcacctgccgcgtactcttcggtgcgccaggatggccggcaaataccagcccggcgatccgcgcaatctcgcgaaagcggcgcaaggccagctcgccggcattgaggctggcggccacgtcgttgagcaagtgctcggggctcagcaacgctgcattcagcaaccttggccagtgcacctcggtagcgctcaatagctccagcccataatcattcacggcaatcgaaaaggtcagcggctgctgttggctgacgcgccacgccagcaagctcgccaaccccaagtgcacctggcgcccggcgaagggatagagaaatagatgccagccctcccgcgattgcagcctttcagccagcaaattctcgcgtgtgggcaggccggaccagcgcagctgggtttgcagcaacggttgtaccgcctgcatctccgggccttcaaagtgcccctgtgccgcggcgtcaaaacgctcgatcaccgcctgggccagctcgtttgaaagcggcatgcgcccgccattccagcgcggcacggcggcttttttggcgttactgcggcgcacataggcggtcatgttttccacccgtaccaactccagcaagcgcccggcgaacaagaagccatcccccggcttgagccgggcaataaagccctcctcgacactgcccaggtgcttgccgccgccgcctttgctccagaatttcagctggatactggcatcgctgacgatggtccccacgctcatgcgatggcgacgcgccaggcgtgcgtccgggacacgccagatgccgtgctcgtcgggctctacacggcggtaatccgggtaagccgtcagtgacaggccgccatggcgtacaaaccccaaggcccaggtccagtcagcctcgctgagatcgcggtaggcccacgcgccgcgcacttccgccagcaatgcatccggggtaaatccgccgcccagggccatgctgaccaggtgttgtacaagcacatccagcggtttgtgcggcgattcccgcgcttcgatgcgccgttgggcaatcgcctcctgggccgccgcggcttccaccagttccaggctgtgtgtcggcaccagtgtcacccgtgatggccgcccgggcgcatggccggagcgcccggcgcgctgcatcagccgcgccacgcccttggcggaaccgatctgcagcacccgttctaccggcaggaagtccacgcccaagtccaggcttgaggtgcacaccaccgccttgagctggccgtctttcaaggcgcgctccacccagtcccgggtttcccgcgataacgagccgtggtgcagggcaatcaatcccgcccagtccgggcgggcgtcgagtatcgcctgataccagatctccgattgtgcccgggtattggtaaacaccaggcaactgctgctggcctccacctcggcgaccacttgcggcaacatcttcaagccaatatgcccggcccagggaaaacgctcggtgacgggcggcagcaaggtgtcgaccctcaattccttggccgtttgcccctgtagattgaccccgccaccctgtgggaccagcacctccaacgcgtgggcctggttgcccaaggtcgccgagatgccccacaccatcagctcaggatgccagcgccgcaagcgtgccagggccagttgcaactgcacgccgcgcttattgccgatcagctcgtgccattcatccacgatcaccatgcgcaggtgcgccaggctcgtctcactgtcggcccgtgcgagcatcagcgtcaggctttccggggtggtgaccagagcggtgggttggcggcgggtctggcgtgcgcgctcgctgctgctggtgtcgccggtacgcaggcccacgctccagggaatttgcagggcgtccaagggtgcctgcagggcacgtgcggaatcggcagccaaggcacgcatcggcgtgatccacagcaccgtcagcggttcagcgggtggcttgcgcttgccggtagcgggcgggcgggtgatggcgaaacggttgagggcggcgaaccacaaggcataggttttacctgcaccggtactggcatgcagcagccctgactggccagccttgaccgctgcccagacgtctttctgaaaggcgaacggtttccagcctttggcggcgaaccattgtttggcgaaatcgtgggtttttgccattcggcaactgacgctctggagggcttagttcaaagacccttaaggctgtgctgacgttccaactgtaggagcgggcttgcccgcgacaaaagctcaggcgccgcgtttaatctggatgcccgcgttatcgttgacgattttcgcgagcaagctcgctcctacttcaaattgccactcagaaactgctgcaggcgctcgcttttcggattgcccagcacatcctcgggggtgccttgctcttccaccaggcccttgtgcaggaacagcacctggcttgagaccttgcgcgcaaagctcatctcgtgagtcaccatgatcatggtgcggccttcctcggccaggccctggatcaccttcaacacttcacccaccagttccgggtcgagggccgaggtgggttcatcgaacagcatcacctcaggctccatcgccagggcgcgggcgatggctacccgctgttgctggccgccagacaggaacgccgggtactgatcggctacacgtgccggcagcccgaccttgtccagatagcggcgggcgcggtcttcggcgtctttcttgctgcaccccagcacgcggcgcggggccatggtgatgttttccagcacgctcatatggctccacaggttgaagtgctggaacaccatcgccaatcgtgtgcgcaggcgttgcagctcggcatcgtcggccacgcgcatgccgtggcggtcgctgaccatgcggatcgtctggccgtccagggtcatggcgccatcgttgggggtttccaggaagttgatacagcgcaggaaggtgctcttgcccgagccactggcgccgatcaggctgatcacatcaccggtcctggccttgagcgacacacctttgagcacttcattgtcgccatagcttttatgcaggccttcaacggtcagtttgtacatggggcgtgcatcctcaaggcgaaagtagatagccgctgcggtaggcctgcgtgccggcgatatggctgatgaccatcccggcagtggccatgcgccgcagcgaacgggcgtagagcaggccggcgtgctggcaatgcacgggcgttacgcggtcggtaatggggtcgatgatttcggcgatcagttgcccggcctctaggtattgacccggcaaggcgctgaacaccagcaagccgcccaccggagtagtcaccggttccacgcccgccaatggagtggccgggtaggccagggcaggcaggggggcgacgtcgccggtgatggcgccgaagtggatcaggtaatcgatgatggcctggcagtccgacgcagcgaggccatgagtgacatcgccttggccgcgcaactcgacggtcaccgacaagctgcccatgggaatcgggaagcgctcgccgaagcgttgctgcaactgccaccacaccagagtgaaacactcatcaaaggactgcccgccagagtcggtggccagcaagttggcctgcgagccgaggtaacgcgccaagggttccactcgcggccagccctgtggcgtggtgtacaggtgcgcgacggcttcgaagtcgcaatgcaggtcgagcaccaagtcggcatcacaggccaggtgttgcagcaccaggcgttgggattgcagctgggtctggggcgtctgcgcggccagggcgttggacaaggctgtgcggatcaagtggatattgtgttggggatcatcgcccaagcgctcttcgatttggtcgccgaccgcttcgctgaggtcgacaaacaaacgattgaagttctgcccgctttccagctcgtagcggcccaaggggatgtccatcaacacttgttcgaggcccaccggattggcgacaggcaccagcacgatttcgctgcgcaagcgtccggctgccgccagctctgccaggcgcgccttgagatgccaggccaccagcatgcccggcagttcatcggcatgcagggaggactggatatagaccttgcccgcggcctgttccgggccgaagtgaaaactgtgcagttgccgcgccgtgcccggcaccggcgcgatcaggtcatgttgctgatgtcgcatgcaggctccttagtggctcggcccgaggaaggccagccagcggcgctccgccaggcggaacaggccgaccagggtaaaggtcaccgcgaggtagatcagcgcggcgatgccgaacgattgaaaggtcatgaaggtggcggagttggcgtcccgtgccaccttgaggatgtccgggatggtcgcggtaaacgccaccgtggtcgagtgcagcatcaggatcacttcattgctgtagtagggcaacgcgcggcgcagtgctgagggcatgatcacgtaggcgtacaacttccagccgctgaggccgtaggccttggccgcctcgacttcgccgtgggccatactgcggatcgccccggcgaaaatctccgtggtgtaggcgcaggtgttgagggcgaaggccagaatggtgcaattcattgcatcgcgaaagaacgcatccagcaccggctgagcacgcactgccgcgatgctgtagatgccggtgtagcagatcaacaattggatatagagcggcgtgccgcgaaacaggtaggtgtagaactgcaccggccaacgcaccaggcgcttgcgcgagacgcgggcgatggacagcgggatcgacaccaggaaaccgatgacgagggcagcactgagcagccacatcgtcatggccaggccggtgatgtgctggccgtcgctgtaaaggaaggggcgccagtattcctgcaacagttcgatcatcgcactgcctcccgggcgcctgcggagtagcgacgttcaagccgacgcaagacaaaattggaggcgctggtgatcaacaggtagatcagcgcggcgagtaccaggaaatagaacagttgataggtactcttgcccgcgtcctgggctgctttcaccaagtctgccagaccgatgatcgacaccagcgcggtggccttgagcatcaccatccagttattgccaatgcccggcagggcaaagcgcatcatctgcgggaaggtcacgtagcgaaaccgctgaccgcgcttgagcccgtaggcggtggcggcttccagctggccgcggggcacggcgaggatcgcgccgcgaaatgtttcggtgaaataggcgccgtagatgaaacccagggtaatcactccggcgctgaaggggtcgatctcgatgtattcccattccataaagtcggtcaggccagtaagccaggtttgcaggctgtaaaaaatcaacagcatcagcaccaggtcgggcaccccgcgaatcaatgtggtgtaaagctgggcggggatgcgcagtaatgccaggctggacagcttggcgctggcgccgagcaggccgagcaagacgctgacggccagggacagcaccgataacttgatggtcatccaggtgccttgcagcaacagcgggccgaaacccttcaagctgaacgcgctcagcccgagggtttgcaacagatcttcgaacataaatcaggacctatggcgatagaaaagcgcccctcccgaggaagggcgccccaggcattatttgccgctgtacaggttcagatcgccgaagtgttttttctgaatggtggcgtaggtgccatcatcgtgtaacgctttgatacctttatccaaaagggccttcagctcagtgttaccttttttgataccgatggcggttttcgagggcagcaacgggtcatcgatggctgcgctgacttcgtagccggcgcccgctggcgacttgagaaaacccaattcagcttgcagcatgtcctgcacggaagcatcgaggcgcccggaggtcaggtcggcgtagacctgatcctggttggcgtaggccttggtggtcaccccggctttatccagcacggccttggcgtaggcttcctggatggtgccttgctcgtagcctacggacttgcccttgagggattcaggtgtcgaataccctgcgccttttttgaacaccagcgaggtggggccggagaacagctcgttggagaagtcgatcgccttctcgcgcactggcgtcacggtcatggaggaaatcacgccgtcgaacttgttagctttcaggcccggaatcatgccgtcgaagtcgctttcgacccacttgcatttgaccttcagctccgcacagatcgcattgcccaggtcgatatcgaagcccaccaggctgccgtcggcggctttggattcgaacggtgcataggaggggtcgacaccaaaacgcaattccttgtattccttggcgctggcaacaccagcagccatgcacagagccagtgcagaaagggtcagcaatgcttttttcattaggtaatccctggaaaccaagataagcgcttttggcgcgtttagaactgttactgagcggtgtcagacggatcacaagtagcaatttctgcaccatagttccggatgggctttttaaaaggtgggataaggcaaatcggagtgtaggagatgcccgaaaatgagcatcagaaaatgggtgcactgtttcaggtcgtatggagattccaatgtggggcttgctcccacagggatttatgtcaaatcagtaggtcttgtagtgtggcaaggttgtcagcctcttccaccgtcttgtcctgacgccagcgcaacatgcgcggaaaccgcaccgcaatcccgctcttgtgccgcttggacagggcgataccctcaaagcccagttcaaacaccatgcttggcgtcacgctgctgaccgggccgaatttttctaccgtggttttacgcacgatggcgtccaccttgcgcatttcctcgtcggtcaacccggagtacgccttggcgaacggcaccagggtgcgctcgctgcccggcgggccatcccacaccgcgaaggtgtagtcgctgtacaggctggcgcgccggccatggccgcgctgggcgtagatcaatacggcgtcgacgctgaaggggtcgactttccacttccaccacaggcccatgtccttggtgcggcccacgccatagaggccttggcgatccttgagcatcatgccttcgacaccaaggctgcgggaggcttcgcgctgctcggccaacgctgcccaggttggcccctcgagcagcggtgagggcagcaatacgggttggttgcactcagcgatcacgcgttccagctgtgtacgacgctcagcctggatatggttgcgccagtcatcgccctgaaattccagcaggtcgtaggcgagcactgcaaccggagcatcctccaggacttttttgctcagggtcttgcggccgatccgctgttgcagcaatgcaaagggttgcaccgagtctttccacaccacgatttcgccatcgatcaccgtgccgtcgggcaggccactcaccaggctgtgcagctcggggaaacgctcagtcaccaactcttcaccccgggaccagatccacagacgcccctcacgcttgaccagttgcgcgcgaatgccatcaaacttccattccacctgccaatcggcgggcgaaccgagcagcgtgtcgaattgctccaccggttgcgccaacccatgggccagaaaaaacggatacggctgcccacctcgttgcgcatgctcgtcggacgattcggcagcgatcagcttgagatagcccgcaggcgtcgggcgattcgataaatcggtgtagcccaccaaccgctgggccacgcgcttgctatcaaggtcggccatggtggcaagcgcgcgggtgaccagcagtttggacacgccgacgcgaaagctgccggtgatcagcttgatgcacaccatcaggctcggctggtccaactgcgcccagagggccggcagccgttcggccaggtccatgggcgaaagcccgcgcaggggcagcaacttgtcttccagccacacggccaggccgtcctcggagctgtaggtggattcgggtaggagcagggaaatcgtctcggccaagtcacccactgactggtagctctcctcgaacagccagggttcgatgccggccgcttcggtggccatgtcccgtagcaggcgcgtgggcaccagttgccgcggccgtccaccggagaggaagtacaccgcccatgcagcatctgctggcggcgcttgcaggaagtaggcttgcagcgccgcgagcttggcattgctggaggtggtggcgtcgaggttggcgtacaactcggcgaaggctttcatgccgtagcctcttcttcgtcatcaccgtactcggtggtgaaaccctgagcatccaagcctttttcccgcagatgacgtaccagcacgccgaccgagccgtgggtaaccattacccgttcggcaccggtttgttcgatggcccataacagcccgggccaatcggcgtggtccgacagcacaaagccacggtccacgccacgccgtcgacgggtaccacgcagacgcatccagccactggcgaaggcgtcgctgtagtcgccgaagcggcgcatccaagtgctgccgccggcggagggcggggcgatgatcagtgcttggcgtaacagcgggtcggtcttcttgaaatcgccggcgtacagcgtctcgggaatgtagacgccggcttcacggtagacccgattcaagggctcgactgcgccgtggctgaggatcgggccgatactggcgtcgaggccatggagaatgcgctgggccttgccgaaggaataacagaacaacacgctcgccttgccgttggcgatattggcccgccaccagtcgttgatccccgcgaaaatctgcgcctggggctgccagcggtagatcggcaggccgaacgtagattcggtgataaaggtatggcaacgcaccggttcgaacggcgcgcaggtgccatcgggttcgactttgtagtcgccggacgccacccagacttcgccctggtattccaggcggacctgggccgaaccgagcacatgcccggcaggatgaaagctcaaggtcacgccgtgatgctccaagcgttcgccgtaggccagtgtttgcaggttgatgtcctggcccaggcgccagcgcaggataccttcgccgggcgcggcggccagataatgctggttgccggtgcgcgcgtggtcgccgtgggcgtgggtgatcacggcgcgctccaccgggcgccaggggtcaatatagaaatcaccggcagggcaatagaggccttcggggcgggcgatgacgaggtccatggggttgccgtgggcgatgggcttgttagttatgaggaggggctgggtgtagaagttctatctgaatgcatgggatccaaatgtgggagggggcttgctcccgatagcagtacttcagtcaatgaatgtgttgactgtcacaccgctatcgggagcaagccccctcccacatttggattcggtttctgctggggaaaaccgggttacttgccaggcgtcagggtcagccttgtcttgccatacaccttttcaaagttttgcggctgcatcgggaagctcaggtattgcgccttgagcgatgggtcgatgccgttggcatagttcgggctcgccgggttgcctgactggccgatgccaccctggcccagcattggttccgctatgccgaagtcgatgatcatgcgcaatgccggcacctgggtggtgttgaaatcctggccccagctgtatggcgccgggttcagggtgttgtggtcgccaccgctggcaagggggccgcggataacctggccgttagtgtttttccagcgggtgctgtgcagcttgccccactgccaggccttgtgatcggcgcccagttggctgtcgccggtgctgatggcggcggcgagggtgcgggccaggatcgcgggtttgtcttctttttgctgtgtgcgcgtgtcgtcccagaatgggctgtcttcacgccccagcaaatgatcggcgacggccgagtaggacaggctggcattgctgacgaaggcgctccagctggcgctgttttcagggccgagtttgtcgaggaagatctgtttagcactttcctgcaggaacaactcgtaaattgctgcgtcagccgaagttggcgcaagacggccatcgaaggccagcaggcggtccagtgcttcgcgagccttggcgcgatccgtcgccgggagggcgtcgatggcctgcttgagcggctgggccatgcctggcgcctggaacatgcccttgagcttggcggcgaaagtggtggtctggtcgtattgcatggcgatcaggctgcggctgtcatgcttgccggcattggccagttgcgccaggcgctcgctacgttccggtgcgtcccaggagttggacaactgcatgccgtagccacgtggcgcagtacgctggttggcggtgccgatccagccttgggccgggtcctggtcgtaggggtgcagcatcgcatcggcgtagccgtcccagtcaaagcgcgtatcccagcccggcgacggcaacaggccttcgccttcgcggcggttggggaagcggccggtgacctgccagccaatattgctggcgtcggcgaaaatcatgttcaacgcgatggcgcggatctcacgggtggcatccgacgccttgccagcgttttgcgcacgggacaggtcgaagaacgcatccaggctcttgtcgtccttgaagttggcggtttgcaaggccaggccaagcccgctggtgagcgcctggctgctgttgagcattacgccgtggcgtgtttcatacaccacttcgcgaatcgagcgctgacccttgatgaagaaggtttcgttgcgcacgccagccggtagccatttgccgttgttctcgtagtacaacgcgctgccctggcgcttgaccttctccaggaacaggtcctgggtgtcgcccttgaccgcgctcatgctccacgcaaccttgccgttgaagccggacagcagggtcggcaggccggcgatcgaagccccgacggcctggtatttcggcgcacgaatctgcacgtagctccacggtgacggcgcttgcggctgggcggcgatatcattggccaataggctcttgccgctgcggctgcgttgcgcaccgatggcccagttgcttgacgtggtgatcgccagcgcgttgaggctgttcaattgctggctgactgtgtccagcgtggcgaggccggtgatctgacccagattcacgcccttgagcttgtcggcttcggcctgcgggatcgcttcgtccggcgcactcggagtgagccaggcgagtttgtctatgccgactttttgcgccagcaccagggacgaaatttcttcctgcaggttgcctgactggctgaaattcagcaggcagaacagcagcgccgaatcttccggcttccagtattccggtttgtagccgctctgggccaggtccgccggcagtttgtcgcgatagcggaacaggtaggcattgacgccccgggcatacacctcaaagaaacgcttgaggcgcggcgacgaggcgctgtacagctcgccggcgcttttcttgaggttgaccgcacgcatgaaacggtcgacatccagcacttgcgggccggacatttccgccaggcgaccctgggccaacagacgcagggtgaccatctgggtgatgcgatcgctggcgtggacgtaaccgaggctgaacagtgcgtcatggaaggtgttgctttcgatcagcggcatgccctgggcattgcggcgcaccgatacattttgtgccaggcctttgatcggctgtacgcctgcaacggggggaagggtgtcctgggtgctctggagctggcaaccggccaggcccaaggcactggccactgccgcggcaacgccgaaccggggaagaaaatgtaagagggctggcgaggccatggcaaagctcctgcggggggtagcgtcagtaaaggcgctacgttagtgagcgcggcgaaacgacgcaagcaggagttgtgtaattgcgtaagcgctcaagctgtgtgcaaatcaatgtgcgagggggcttgctcccgattgcggtgaatcagtcagctcatctgtagctgacactgcgcaatcgggagcaagccccctcccacattttggtcttcagcgtggcttatgcgccatggcacttcttgaatttcttcgcgctgccgcacgggcaaggatcgttacgacccacatccttcaaggcattgcgcacgggctcctggtgagcgtggccgcagttggggccgtggacatggccgtggtcgtgatcatggtgctcatgatcgtggttgcagtcaggaccatggacatggggttgctgagtcatcgatgttgctccggaataaaatcgccggggattatctcgccattgtgcgcgacctgcacgtcattaccgatgaataatccggttttcagttcgccttccagacgataaggcacgggctggtcgggatttttcagcatctgtaccacgtcacgcacctgcggccagaggttggtgcgtaccgaaacccggaagaacttatgactgcgcggcggtacggtcagccattcgttggactcgccctcggtcagcagcaggttgcccaggctgatcttatagaccaggccacgcaccgtcaggtcggcgtcgtcgcggttgtctacgcgaaagtacagcttgaacttctgctccagcagcttggcccgcaccacttcgaccttgaccagggacacgtggggcggaggcgaatcgtcttcgaaccacgacgcgcagccggtgaggcccagggtcaacgccagcatcaagctgtacatccgaagcatggcgttatccctttcgagtgattagaggtagctggagcaacacttcttgaatttctgcccactgccacacaaacatacatcattacgtccgatcgtcacgtccaccgtcggatcgatgaagtaccagcgcccatcattctgtacgaaagatgattgctctcggtggctgtgttcgccgctgctgtcatgccagcgcgcggtaaaggtgacgaaggcgtgttccggctggccgccgaacacttctgagctttccacctcaaggcccaaccaggtgctctgggcactccaggcggcgatggcgtcgcggtccagcccggcctgttgcgcgggcagggtagtggccaccaggtaatcgaccaggcccagcacataggcgctgtagcgcgagcgcatcaacgcgctcgcgcagggtgccgggtggccggcgtgatagtggccgcagcaggcatccagcagattgccgctgccgcacgggcaaatggatgtactcatcgggttaccaccaatactttccgaagttttccgggttggcccagaagcgggcgttgagccagtccggcacctgtttatagtcaagcagatcataggtaaacagcgtcaggacctgctcatcgcgctggaagtactcgccggcttgcaaggccagggagaagaaatcggtttccttccaagcgcaggcgcccaggtcgaccagcacggcaatgcggctggcattgaggttgcgaatgccgccgagcaaggtcagaccctgcgcttttgacaggtgctccaggcagtcgactaccaacgccaggtcaaaacgctgcgccgccagttccggcggtaacggccctggcgctgcccggaaaacctgggtgtcagggtgggcctgctcaaaggcatccagcgccgggaattggctggcacccactagcagcaagcgctttggcccttgaagatcaagcaagacagccaaggcttgctggggcgtacgggaagaaattccagcggtcattgcaaatcctcacatcaagaccgtagagactagcgcggctgagcgcgtgggcctagcgcgcggcggtcgatacctacctggcagtaaccgtctcatcggaagttttttgatccttcactggcaaatcgcctgtagaagtcgttactgtgcatccaaagaaaaatttgaaaacactcaggagccccatgatgcgtaaggtttttctgctggccctgttggtcagccccgttgccctggcccagagcgtcagtgtcgaaaccaactcgttgatgcgcctgcccagcagcaccagcgtgctgcaactggagcgcctggaggtggcggactacggcactttgctgattccgtccactatcagccaggtcacggtggaggagctgcacctggggcgcgacgcacgcatcgccattgtccccggcaatactgcgctgcaaatgcaagtgcgccaggcgcaactggagcacggtagccagatcacttcacgcggggcccctggcacccatgaaaaaccggccaaggctgggcgtgacctgatcttgcggatcaacgaccttagcgctgaagaattgtctgtggatgcccgcggcggggccggtgcccaagggtatgcggggctcgatggtgccaacggcgaggacccgggatgtacgtggggttcggctgggcgcggggccaacggtgataacggcggcgacggcctgccgggcgcttcgggggcgagtgtaaggctggagttgccgcaagactttcctggcgacaaaatcaaggtctgggttgatggtggcgccggcggtttggccggtatagcgggcaaacccgggaagggtgggcagtcgaaggggtgcctggtgtaccgtgctgacggcggcgacaaaggccggtccgggttggaagggcagccggggccggctgggcctgcggggtctgtgaccattcagcggctctgagtcgcctggtctgacgctatcgggggcaagtccaatcgtcgcaccgcccctcccacattttggaatgcattccaaagtgtgggagggggcttgcccccgatggtggcctcagggccgcctcagaacatcggtcgagccgaagcaattgccaccaccaccaaccccacgatcaaattaattcccaccaacctgcgaatctgccccagcgcagccgcgcccgctggccaatcttcggccgccaccgccttgcgcagctccgggaatttcaacgcctggatgcggataaacagcgccgtcatcaccagatacaaacccatcatcacttgcacatagcgcggtgcagtctcaaatccgttgaagcgcaggtgcaaaaggcctatgccgctgatcggcaaaaccagcactgtcacccacacccatacgaaaaaacgttgaaacacattcgcccacagcttgagccgggcggggccctcaagggccgccatggcggcggggcgcaggatcatccaggcgaaaaacataccgccgacccagatcagggcagccagtacatgcagggtgtaagcgaagctaaacgcggtcattgtggtactccgttctgcgcgggattaattagcggggtatgatagcggccgatccgaaccactgaaaatttatccagcgttttttgcgcccgactatccatgatcagcactgaactcaaaaccacgatccagggcgcctatacgcgttttctcgaagccaagagcttgaaaccacgctacggccaacgcctgatgatcgccgaagtggcgaaagtcctcggggatatcgacaccgacgacgaaggtcgccgcgagggcgagcccgcggtcgtggccgtcgaggccggcaccggtaccggcaagaccgtggcctacagccttgccgcgatccccactgccaaggccgccggcaagcgcctggtgatcgccaccgccaccgtcgccctgcaagagcagattgtctacaaagacctgcccgacctgatgcgcaacagcggcctgagctttaccttcgccctggccaaggggcggggccgctacatgtgcctgtccaagctcgacgtcctgctgcaggaaggccacgcgcaaaccgcgaccgcctcattgttcgaagaagaaggcttcaagatcgaggtggatgaggccagccaaaaactgtttaccagcatgatcgagaaactggccggcaataaatgggacggcgaccgcgacagctggcccaccgccctggaagatgccgactgggcgcgtctgaccacagaccacagccagtgcaccaaccgccattgccccaactttggccagtgcgccttctacaaggcccgcgaaggcatgggcaaggttgacgtcatcgtcaccaaccacgacatggtgctggccgacctggccctgggcggcggcgccgtgttgcccgatccgcgcgacaccctttacgtattcgacgaaggtcaccacctgccggacaaggccatcggccacttcgcccattacacgcgcctgcgttccaccgccgactggctggaaaccaccgccaagaaccttaccaagttgctggcccagcatccgctgcccggtgacctgggcaagctgatcgagcaggtgccggaactggcgcgcgagatcaagacccagcagcagttcatgttcagcgcctgcgaacaggtcgcagatttcaagcccggtgaagacgtcgagggccgtgagcgcccgcgccatcgctttgtcggtgggatgattcccgagcacatgcgcgaaatgggcatcgagttgaagaagggcttttcacgcctgaccgacctgttcacccgcctgaccgacttgctcaaggaaggcatggatggcgaggtcaatatcggcatcgccagcaaccaggccgaagaatggtacccgttgttcggcagcctgctgtcccgctcccagggcaattgggagctgtggaccgccttcaccgtcgaagaccccgaagacaacccgccgatggcccgttggctgaccctgtcggaaagcggtgcgctgtttgatatcgaggtcaacgccagcccgatccttgccgccgaaatgctgcgccgcaacctgtggaacgtagcttacggctgcctggtgacgtcggccacgctgaccgccctgggcacctttgatcgcttccgcatgcgtgccggcctgccgaaaaaggccgttaccgccgtggtgccaagcccctttcatcacgccgacgccggtgtgctgcgggtgccggacctcaaggccgatcctcgggatgcggcggcgcacaccgcggcgatcattcgcgacctgccatcgttggtcgaaggctcccgcggcaccctggtgctgttctcgtcgcgcaaacagatgcaggacgtgttcgatggccttgaccgcgactggcgcaagcaggtgtttatccagggcaacctgtccaagcaggaaaccctgaacaagcacaaggcgcgggtcgatggcggtgattccagtgtgctgtttggcctggccagctttgccgaaggcgtggacttgcccggcgcctactgcgaacacgtggtaatcgccaagatcccgttctcggtgcccgatgatccggtcgaggccgcactggccgaatggatcgaagcacggggcggcaacccgttcatggaaatctcggtgccggatgcttcactgaagctggtgcaggcctgcgggcgcttgctgcgtaccgaggaagaccggggcaccatcaccttgcttgaccgccgcctggtcacccagcgctatggcaaggctatcctcaatgccttgccgccgttcaggcgcgaaatttcttaagtcaccgtgggcgaattcgcccactgcgtggtctatctcatcactatcatcaggccattcatcggccgtctgggagaaccttgttcgtatgattcgcacgctgcccgccctgtttgccttgctgttcgctgcgccgttgatggctgcacctgccgggcaacaaacgctgttcaacttcgtcaggcctgccgatgtggtcaaggtggcgacccaggacgccagcctgccgcaatacaacgccgaacaaacgcccgaaggcgaggtgctgcgccgcatcaccttcaacccggcggccgagccgagcctggtgctcagcccgcaaaccggcgtgtgggactggtcgcaatccagcgccatgagcctgcgtatccaaagcgccatgaactgggcgctgactctctacatcaaggtgcagagcgccgacggcaagaccctggtcagccgcgtcgacctgccggccggcccggcccagaccctgctggtgccgctgcaagccaactcgccactgagccagggcatgaaggccggcccgccgatgcctgtcaccgtggagggccagcgggtgttgctggccggtagtgccggggaaatcgaccgcagccaagtggtctcggtgaccctgtcgatgatcaagcccaacgccgcccaaagcatcctgctggagcgcttcggcgtgcaggacagcgaaccggtgttgaaggccgcctacagcgaattggtcgacgcctatggtcagtcgacccgtgcgcgctggccggaaaaggtcagcagcgatgaccagctcaaggctttggccgccaaggaacagcagcagctcaagacctggctggccgagcgggacaaatccgccctggacgcatatggcggctggaataaaggcccggcattcgacgccagtggctttttccgcaccgagaagcgcgacggccgttggtacctggtgacccccgacggacatccgttttattccctgggcgtcaacaccgtggcgccggacaacagccagacctatgtggcggggcgtgaatggatgttcgcggcgctgcccaaggccggcgaacctttcgacaagtattacggcagcggcgacaaccgcagcggcaacggtgccggcgaaggacgtggctttggctcgggccgctggtacgatttctatggcgccaacctgcagcgcacttatggcggtgaaggtctggaccagaagcgctgggtcacccacaccctcgaccgtctgcaagcctggggtttcaacaccgtaggcaactggagcgatgcggacctggccacggccgaccgcgtaccgtacaccctgccgctgtcgattgtgggtgactacgccagcatcagcaccggcactgactggtggggcggcatgcccgacccgttcgacccacgctttgccatggccaccgaacgcgccgtggccatcgccgcgcgcgatcaccgcgatgacccgtggttgatcggcttctttgccgacaacgagctggcctgggccggccccggcgacgatccgaaagcccgctacgccttggcctacggtaccttgcgcatgaccaccgatgtgccggccaagcgcgccttcctcaagcaactgcgtgacaaataccgcaacgaagaaggcctgtccaaagcctggggcattcatttggcgggctgggagctgatggaagacccaggcttcgagccaccgatgcccaacccggagcacccggaaatcgaggccgacttcaagtatttccagaaaacgttcgccgatgcctacttcaagacgctctctgactcgctgaagtggcacgcgcccaaccaactgttgctgggcggccgttttgcagtgagcaccccggaagcggtggcgtcgtgcgcacagtattgcgacgtgttgagcttcaacatgtacaccctcaaaccccaggacggttatgacttcgccgccctgcgcgcattggacaaaccggtactgatcaccgaattcaactttggctccgccgaccgtggcccgttctggggcggcgtgacgcaactggcccgcgaagaagaacgcggcgcggcttacagcgcctttctcaagcaggccatggccgagccgtcgatagttggcgtgcactggttccagtacctcgaccagccggtgacagggcgtctgctggatggcgaaaacggccacttcggccttgtcggcatcaccgatgtgccgttccaggggttcgtcgacagcgtccgtaaaagcaaccttgcggcagtcgaccaattgggcaaggcggccgaaaaagccaaggcggccggtgccgtgcgtgagcacgaaggtggccgatcagcccaagcaggcaaaggcgcggggcagggcgctggtcaggccggtgggcactctggaaatggacattgattcatcgttgacgggttcacaaaaccgacaatgactggaacaatgtcgaccatttcctacagtattttcaaggcggcttaggtgcagattcagggtcattacgagctccagttcgaagcggtacgcgaagccttcgccgcactgttcgatgacccccaggaacgtggtgccgggttgtgcatccagatcggcgggcagaccgtcgtcgacctgtgggccggtactgccgacaaggacggggccgaagcctggcatagcgacactatcgtcaacctgttctcctgcaccaagaccttcacggccgttactgccctgcaactggtggcagaaggcaagctcaagctcgatgcgcctgtggccgattactggccggcatttgccgcggcgggcaaagaagcgattaccctgcgccagttgctctgtcaccaggccgggctgccggccatccgcgaaatgctgcctaccgaagccctctacgactggcagttgatggtcgacaccctggcggccgaggctccctggtggacaccgggcgaggggcatggctatgaggcgatcacttacggttggctggtcggcgaattgctgcgccgtgccgatgggcgcgagccgggggagtccatcgtggcgcgggtcgcacggcctttggggctggattttcatgtgggccttgcggatgaagagttttatcgtgttgcccatatagcccgcagtaaaggcaatatgggcgatgaagcggcacaacggttacttcaagtaatgatgcgcgaacccgcagcaatgaccacacgtgcatttgccaacccaccgtctattctgaccagcactaacaagcccgaatggcgacgcatgcagcagcccgcggctaatggtcacggtaatgcacgcagcctggccgggttttatagcgggttgttggacggtagtttgctggaaagcgacatgctcgaacaattgactcgtgaacacagtatcgggctggacaaaaccttattgacccaaacccgcttcggcctgggctgcatgttggatcaaccgcagttgcccaatgccacgtttggcctggggccacgcgcattcgggcatcccggggcaggcggctcagtcgggtttgccgaccctgaacatgatgtcgcattcggttttgtgactaataccctagggccttacgtacttatggacccgcgtgcgcagaagttggtcggaatattggccgattgtctataaaccccttgctgtttcacaattttttgttacaaaggcaagtataagaaagatgctgaacgacacgatgtaacttgaatgttctttaagcgtcggtttaacgggtcacgagaccccctggttttttctcattttgtggatatctcatgttatcgaacaagtccttggcactggcgctgtgcctcactattacgggttgcgcacaaactccacaaaatgatgccgaaggtgggcattggtggtcattcggatcggacaagactgcgaccaaggacgcagtgacccaaaccgacgccaagcccgatgccaagcctgctgcaggcgccaagcccgttgagcccgtcgccgctgctgctgcaccggctccggccaccaaggctgataccggttacagctggtggccgttctccaccaagagtgccgaagagaaggccgccgatgccaaggctgacctgaaagccgacctcaaggcagccaccccgacgtcggacgcggcgcctgtggtcgccaagaccgacaccgagcctcactggtggtggccgttcgaaagcaagccaaagcccttggccaaggtcgacgtgaccaacgtgcagatgcctgacccgaaaatcactcaagcctggctggatgactacgaacctcgcctgcgtgaggccatcaagggcagcaccctgcaacttgagcgtcgcgacaacgtgctggtagtgattgcccctgtcgacggttcctacaacccgaagcgcccggcgatgttgctgccggtgaccctgggcccgtttacccgtgtggccaaggctgtagaggctgatccaaagaccgccgtactggtcttgggccacgtcgacgccactggcagcgcgccggcgagccaggcgttgagcaaggagcgtgcgcagtcgattgcatcgattttcagcctcagtgggttgaagcaggaccgcctgatgctgcgtggcatgggcgaccttatgccgcgtgccgccaacgacagcaatcagggccgtgcgctgaatcgtcgcatggaaatcatgttcactcagcgtacaacgatgttggcactgctgagcaagtacaactcgggcaagacgccgcctgttgctgaaatggttgccgtgcaggacgttcccgccccggcacctgcggcaaaggcaaaagcgccagccaaaaaggccccggccaagaaagctgctgccaagcccgcggttaaaaaagccgcagccaaaccggcagcgaagaaacccgctgcggccaaagccaaagctgctgcacccgcttcgaacgaccaggcaaaaaactgagccgttgaaccacgaggataaagccgcatgacccaggcactggccgatatgcgccgtgactacacacgggacggtttgagcgaggcccaggccccggatgagccgtttgcgttgttccaccaatggttcggtgacgcggtgaaaaccgaacagccaccggtggaggccaatgccatgaccctggcgacggtcgaccaggacggtcgcccgcactgtcgtatcctgttgctcaagggcctggatgcacagggctttaccttcttcactaactatcaaagcgccaagggtgaacagctcgcggcgcgtccgttcgcagccatgaccttcttctggccgaccctggagcgccaggtgcgcattgaagggcgcgtggtcaaggtcacccctgaagagtcggatgcttattaccaggtacgtcctttgggcagccgcctgggggcttgggcttccccgcagagccaggtcattcgtgaccgcgaagaactgcaggaactgctcaaggccactgaacagcgtttcagcgatacccagcccgactgccctgagcattggggtgggtaccgtttgctgcccgagcgcatcgagttctggcaaggccgcgccagccgcctgcatgaccgcctcaactatcgcctgcaaggggctcaatggtcccgcgagcgcctggcgccctgagcgtcacctttcgtcatcccgcctgaatcaaagctattgcgctggagtccctgatcaagagacctcggcgctttcggctgcgcggctacactggtcaaacaggttatggcatcgttcggcgccataaccttggttaccgttcgtcgagttttctggtgctggcagtctgtactcaggctgaatgaaaacaattttttgcctggcttgccgtgacaggcgccaagccagagcgtttaatgaatacctgtcctttggagttgatgctatgcgtaagtccgttttactagttgcctgctttaccaccctgtcgttgctcttgggtggctgcgcctcgagtctgaccggcgactcgtactctcgcgatgaggcgcgtcgtgtacagaccgtgcgcatgggcaccatcgaatccctgcgtccggtgaaaatcgaaggtaccaagaccccaatcggcggcgctgcaggcgcagtcatcggcggcgttggcggcagcgccatcggtggcggtcgtggcagcattgtcaccgccgtgatcggtgcggtcgctggcggcctgttgggctcggccaccgaagaaggcctgacccgtacccagggcgtggaaatcaccgttcgcgaagacgacggcagcatgcgtgcctacgtacaagccgtgcaggaaaatgaaatcttccgcatcggcgaccgcgtacgcatcatgaccgttgacggtaccagccgcgttacccgctaagcgctagcgagcaggcaaagaaaaaccccagccgggtgaccggttggggtttttttatgctgttttcccagagggtcaggctttcttgcggctcgccattgccgtcaccgcgtacccgataaaggccgccaggatcgacccggtcagaatgcccatgcggtcttcaccggcaaactcactggcgcccggcacaaacgccagtgagccgacaaacaggctcatggtaaagccgatgccgcacaggattgccacccccagcacctggccccagttggcgccgctgggcagtgaggcgataccggtcttgatcgccagccaggtcaggccgaatacgccgacggtcttgccgatcaacaggccagcggcgatgcccatgggcacgtggtgggtgaagctgtccaggctgacgccgctgagggagacgccagcattggcgaatgcgaagagcggcaggatggcataggccacccaggggtgcagggcgtgttccagggtcagcaacggtgaagtctcggcatttttggtacgcaggggaatgcagaacgccagggtcacgccggccagcgtggcatgcacaccgctcttgagtacgcacacccacaggatcaagccaacgatcaggtacggcccaagcttgatcacgcccaggcggttcatcgcaatcaaggcaatcaagcaagcccccgcgcccgccagggatgcgccggacaagtcggcggagtaaaacaacgcaatgacgatgatggcaccgaggtcgtcaatgattgccagggtcatcaggaacagcttcagcgacaccggtacgcgcttgcccagcagggccagcacgcccagggcgaacgcaatatccgtggccatggggatcgcccagccggcgagagcggcggggttgtccttgttcagcgcccagtagatcagggccggcaccaccatgccgccgatggctgctgcgccgggcagtaccacttgggagggcttggacaggtggccatcgaggagttcgcgcttgacctccaggccgatcaacaggaagaacagggccatcaggccgtcattgatccacagcagcgccggcttggcgatggtcaacgctcccacctgtgtgaccaccggggtctcgaggaaggcgttgtacaggtgcgacaacggcgagttgttgatgatcagcgccaaggcggcagcggcgatcaacaacaggccactggcggcttccagctggaagaaacgggtgaaagtgctacgcagaggcaagggatgctctccattccaggttcaataggtgggtaccctaacccgtactgttagttgttaaaacaaaagttatattcttatttgttataagagattggcgcggttaccgatgccttgaagactagcaattgtgtgtccaattgagtcggcactgtatctgtgttgagtgtaggaaacatcctaagatcaagtctgaaaacctttagagaacccaccatgagcgaccaccgtacctgggcccgcgaagccattcgcatcattgaagcggacttccagcggagcgctgacacccacctgatcccgttgccattaccggggttgccaggcatcgagctgtacttcaaggacgagtccagccaccccaccggcagcctgaaacatcgcctggcccgctcactgttcctttacgcactgtgcaatggctggctcaagcctggcgccccggtggttgaagcgtcgagtggttccacggcgatctccgaagcctacttcgcccgcctgctgggcttgccgtttattgcggtcatgcctgcttccacgtcccaggagaaaatcgcccagatcgccttttatggtggcaagagtcatctggtccaggatccgacgcagatctacgcggaatccgaacgcctggccaaggagggtggtggtcatttcatggaccagttcacctatgccgaacgtgctaccgactggcgggcgaacaacaacatcgccgagtcgatcttccagcagatgcgctttgaacagcacccggagcccaggtggttgatttccagccccggcactggcggcactaccgcgaccctgggccgttatgtgcgttatcgccagcattgcacccgcgtgttgtgtgccgatgcagaacgttcggtgtttttcgacttctaccagagcggcgacgccagcctgcgcttggagtgtggctcacggatcgaagggattggccggccgcgagtggaggcgtcgtttctgcctgcggtgattgatgcgatggtcaaggtcccggatgcgttgtcactggcggccatgcattatctggccgagcgtctggggcgacgggttggcggttccagcgggaccaacctgatcggcgcattgatggccgcgcaacagatgaaagcggcgggggagtcggggtcgatcgtggcgatcttgtgtgatggcggcgagcgttatgccaccacctattatgaccaggcgtggttggcggggcagggctatgagctggagagcttgattgcggcggtggcggcgagtgtcgagcgcggtgaaccgttgcccaacactatcctgcgcgccaatatctgacccaccgcaaatcaaaatgtgggaggggcggtgtgctcaggcttcaatgccgagcatatcccgcgccaacgcctcggcaatccgaatcccgtcaacaccggccgatagaatcccgccggcataacccgcaccttccccggccggaaacagaccttttacgttcaggctctgcatcgactcatcgcgggtaatgcgcaacggtgacgaggtgcgggtctcgatccccgtcaacactgcatcgtgcagcgagtaacccttgatctgcttctcgaacgccggcaaggcttcgcggatggcttcgatggcgaagtccggcaaggccagggccaggtcgcccagggatacgccgggcttgtaggaaggttccacactacctaaggcggtggacggtttgccggcgataaagtcgcccaccaactgcgccggtgcctcgtagttgctgccgccgaggatgtaggcgtgggactccaggcgctcctgcaactcgataccggccaacgggccacctgggtaatccacttcgggggtgatgccgaccacaatgccggagttggcgttgcgctcgttgcgcgagtactggctcatgccgttggtcacgacgcgattgggttccgaggtcgcggccaccacagtgccgcccgggcacatgcagaagctatagaccgaacggccgttcttggcgtggtgcaccagcttgtagtcggccgcgcccagtttcgggtggccggcgtacttgcccaggcgtgcggcgtcgatcagcgactgcgggtgttcgatacggaaacccaccgagaacggcttggcctccatgtatacgccgcggccatggagcatgcggaaggtgtcacgtgcgctgtggcccagggcaagaatcacgtgccttgagagaatctgctcgccgccgtcgacgaccacgccgttcaactgcccatcttcgatcaacacgtcggtaacccgttgctcgaagcgcacttcaccgccgagggcgatgatctgctcgcgcatgttttccaccacgccggtcaggcggaaggtgccgatatggggcttgctgacgtagaggatctcttccggcgcgccggccttgacgaactcgtgcagcaccttgcggccgtggaatttcgggtccttgatctggctgtagagcttgccgtcagagaaggtgccggcgccgccttcaccgaattgcacgttggattcggggttgagcacgcttttacgccacaggccccaggtgtccttggtgcgttggcgcacttccttgccgcgctcgaggatgatcggcttgaagcccatctgtgccagcagcagcccggcgaaaattccgcaggggccaaaaccgaccacgatcggccgctcgaccaggtctgccggggcctggcccaccaccttgtagctgacgtcgggggccgggttgacgttgcggtcgtcggcaaacttgagcagcagggcggcttcgcccttcacgttcaagtcgatggtgtagatgaagcacagctccgacgactttttacgggcatcgtagctgcgtttgaacagggtgaaatcgagcaggtcatcactggcgatgcccaggcgctgcacgatggctggccgcaggtcttcttcgggatggtcgatgggcagcttgagttcggtgattcgtaacatgacaggatccggtaggcggcgggcgagaaggccggctgttttgcaaaccggcgattataagctccaatggcgactttccgtcaggttaaaacagctcagggtcgaatcagtcgtcccgcgaaccgccaaaggctgcgcaaccacgctgcacctggccgtttacccgcaactcggcgctcatgtgttgcaggctgccgctcacactgtcgacgcagcgctggggcgccacccacagctcgatgtgctggttattggcttcggtcatcaggttgaagcggccgtcgcccagttgttcttcgacgtacggcactgccaaaggtggttggccctcacgttccagcaccatgcccttggccgtgacgttcatcgcccaggccggtttatggccgttggcgcgcaggatcatgcgcttgaagtccgggtcggtacaggcggaggtcgagcgttcgacgcggtacagctgttgcagctccacttcgccctgggtaccggtggcaaccccggaaaacttgccgcgcagatcggcaaacagtgcgccttgctggccggccagggaggccgcttcctgcaggatgctggtgccgccggtatccttgaccacgtagttacgctggtcgccgcacggctggaacaacagcttgccgtccaccgcggtcaattcaccctgcatacgggtcagcccgacggtagatggcttggccggctcgttttcgaacagctggcaagcggcgaacaagggaagcaaggcacacagggcgagggtacgggcggcacgcatattgggtctccaaacaagtgccgccacgttacgcaggctggcgccgcatcacaagcccgctcgccggcttcaggtgtttctgacagacatcaaattcagcctacgataaaggtctgaccggtttgtaggccctcgacgctttttgcgtaagccagtgccacatcggcagctggagctggtttgtagccacggaaatacggtgcatagctgcccatggcttccagtagaacggtcgggctcacagcatttatacgcaggccacgtggcaattcaatggccgccgctttgacgaatgcgtccagtgcaccgttgaccaacgctgccgaggcgccggtgcggatcggatcacggttcagtatgccgctggtgaaggtgaacgaagcaccgtcgttggcatattcccgaccgatcagcagcaggttgacctggcccatcagcttgtcacgcaggcccagttcaaagtcgctttcgctcatctcgcccaaggctacgaaattgacgttgcccgctgcgcagaccagtgcgtcgaacgggccggtttgttcaaacaatttacgaatcgaagcgctgtcgctgatgtccacctggaaatcgccgctggtgcgaccgatgctgatcacttcgtgacgctggctcagctgcgccttcaccgccgaaccgactgtgccgctggcaccaatcaataggattttcatcgtgctgttcctccagagatagtgaaggttcagtctagtgtggctttttcagcggataaacgcgctaataggcaacctttggttttcaaatggaaacaatccatgagcgaaatggatgatctggcggccttcgcggtgctgattgaagctggcagctttaccctggccgccgagcaactgggttgcagtaaggggcagctgtccaagcgcatcagccagttggaagcacagtttgccgtggtgctgttgcaccgtacgacacgcaaactgagcctcaccgccgccggcgcggcgttgctgcctcaggcacaagcgctggtggtgcaggtggagcgcgcgcgccaggcattggcgcggctcaaagatgatttgaccggccctgtgcgcatgaccgttccggtctcgttgggtgagaccttctttgatggcttattactggagttctccaaacaatacccgcaggtccaggtcgaactggagcttaataacagttaccgcgacttggcccgggatggttttgacttgggcgtacgctcgggtgccatcgaacatgaacgcctggtggccaagcctctgctggcgtggcgcgagatgacctgcgccagcccggcctatctggaacagcatggcgaaccactgaccccggcggacctggcgacacacatctgtttgctcaacagtcactacagcggacgcgaggaatggttgtatcaccagcaaaacgaattgctgcgggttcgggtaagcggcacgtttgcctccaaccactacaacctgctgaaaaaagccgcgctggtgggcgccggtatcgcgcggctgccgtcctacgtattaccgaaggaactggccgaaggccggttacgctggctcctgcgcgactatcagacgcgcagcatgccgatgtacctggtgcacccctaccagggtggcctgccgcggcgtacccaggtattggtcgattacctggtggactggttcaggcgcagcggcgaggcgttggatcggctttaacgcaagcgacgggcaatccagtggtcgatggacaggctgcccggccccttggcgagcaacagcaacagcagcgcaatccaggtgccgtgggtcggataggcatcagggtagacgaacaactggatggtcaaggtcatgccgatcagggccagggccgagaagcgcgtagccaatcccagcaggatcagcaccgggaaaaaatgctcggcaaaggtcgccatatgcgcggccacttccggcgccagcaacggcacgtggtactcgctgcgaaataaccacaacgccgacgcagcaagcttgggctcgccccattggaatgtgccgctgaccagatcgatggcaaagccttcgactttggtttgcccggatttccagaacactgctgcaatggagaagcgcgcaataaacgcgatcaggctgtaggggatgttttcgaacagggcgatggcccgttttaccaggcagggggcgggcgcgttcatggcgatacctttctttccagatgcaaatgagtgatggcgtcgtggctgatcagcagcttgagacattggtgcaggtcgaattcggccgaggcttcaagcgcattggcaacggccgcctccagcccggcgccttgcttgaggcggttgataaagatgaccgagccactgtcgatggcaaatactttgaccgccaacccttggcgcaagaccagagcgccctgggcatgccaggggttcaacgtggcgatagcgtcctcggtctggtgcgcggcccataccgcgacgattgcatagggggagttcagcgtggcgagcgatgggtgcagttgcacacgcaggtgtccgagttgctctgcgccttgcagttgttgaagaacgctgggctggtccagcgcctggcgatccgccgcgtgataggcgcgaacccgcaggcgttccaatcgcgctatatctgccaggtaaggcacgctcgaagccggctcaaacccttggataaagtcagccaaagagctgccgtattcgctgatcaacggggtagtgggcggataagcctggacgtacaggccggccatggcatggaaaaactcatcgcctaccaatcgccgcaccaccggataagcggccgccagcccatcgttcaacgagctgtgaacgttattgcgatacaccacgaagcggctcgccgggtcggcaccattgctgctgaacacaccctcgggacagactgcgtcgggcgccagcaaagcctgggcaaattcgtgttgaatactcatctggccacctgcgacaaataccattgggcttgccgggcctcggcctgcagcacgctgaatgccggcacgtgattatcccgttcgatcaaggtggctaccgggccggtccgtgtcagtacctgttcgtacaattgccacacggcgttatcgataggcgcgccgtggtcatcgatcagcaggcggtcgcccaggctgtcggtgtcttcggcaaagccggccagatgaatctcaccgactgcgcgcaatggcagggcattgatataggcaagtgggtcgcgctgatgattgatgcaggagacatagacgttgttgatatcaagtagcaggccgcaaccggtacggcggatgatctcgccgatgaagtcggtttcgtccagggtggagcgctggaactgcaggtaggtcgaggggttctccaacagcatcggccgcttgagtgtgctttgtacctgatcgacgtggtcgcatacccggctcagggtgctggcgtcgtaggccaggggcagcaagtcgttgagaaacaccgggccgtggctggaccaggccaggtgttcggaaaaagactggggttgatagcgttcgatcagcgtgaccaggcgtgccaggtgctcatggtccagtggaccttcgccgccgatggacaggcccacgccgtgcagtgacagtgggtactgcgcgcggatcaagcccaggtagtgatgaaacgggccgccggccaccatgtagttttcggcgtgcacttcgaaaaaaccgatgtcggggcaggtctcgagcacttgggtaaaatgctcggtcttcagccccagcccggcccgcaagggcaggccaggcgcctgagccagtgagatcgtgtagtcgggtgttggcgtcatcatcagtactcaggcttgcggggggatcaggacttggcgttgaaggcggcttcctggccgaaaccggtcggcgaggtggtgcttggggtctgggtgcaggtgccggcggtcaccagtttccacgcgttggcctggtctttggttttggaggtgccagcgcaggaagtgccagcacccgcggcgcaatcgttcttgccggcttcagccacgccgaagcatttctgcatctcgtcggccgcatgagcggtggtggtcagggcggacaggctcagggccgagcccagggccaggatgagggaggcggcagacagtttggtggtcatgggtataactccagcagtgggttgaatgagcgggcttgattgcctgcttgcaccactagagagagggggggtgagtacgttacaaagagttcgaaaataattcgagaatctttcggttcacacaaaaaatgtgggagggggcttgccccgatagcggtggttcagtcacaagatgcggtgactatcagcctgccatcgggggcaagccccctcccacatttagatccggtttactcagttaccgggtcttagccgccgaggtacgcctcccgcaccttcgggtccgtcagcagttgctcgccagtcccctgcatcaccacccgaccgttttccagcacataggcacggtcagcaattttcagcgcctggttggcgttctgctccaccaggaacaccgttacaccatccttgcgcagctgttcgatgatgtcgaagatctgctggatgatgatcggtgccagtcccagggacggttcgtccaacagaagcagcttgggcttgctcatcagcgcccggccgatggcgagcatttgctgctcgccgccggacatggtgccgccgcgctggctgaagcgttccttgaggcgcgggaacaggtgcagcaccttgtccatttgctcctggtagtcgcccttgtcggtgaagaacccacccatggccaggttctcttccacggtcaggcgcgagaacacccgacgaccctccggtaccacggcaatgctcttgcgcatgatctcggcggagtgcttgcccaccagttcctcacccatgtaacggatgctgccgccgtgggcctggggcgaaccgcacagggtcatcagcagggtcgatttgccggcgccgttggcgccgatcagggtgacgatctcaccctggcgcacttcgacattgacgtcgtgcagggcctggatcttgccgtagaacgtggaaacgttttcgaactgcagcattttacgcttcccccagataggctttgatcacttcaggattgtcgcggatctgctccggcgtgccgtcggccagcggcgtgccctggttgatcaccacaatatggtcggaaatgctcatgaccagtttcatgtcgtgttcaatcaacagcaccgtggcgtcgttctcctcacgcagcacgctgatcagcgccttgaggtcttcggtttccttggggttcaggccggcggcgggttcgtcgagcatgaggatccgcgggcgcgtcatcatgcaacgagcgatttccaggcgacgctgctgaccataggccagggtgccggccgggcggttggcaaattccgtcaggttgaccttgtccagccagtacgccgcgtactccatggcctcgcgctcgctcttgcggaacgccggggtcttgaacaggcctgcgaagaagttggtgttcaaatggcggtgctgggcgatcaacaggttctcgactgcggtcatgtccttgaacaaccgcacgttctggaaggtacgcaccacgcccttgcgagcgatctcgtgacccgccaggccctggatcggttggccgtccagcaggatgctgccgccgctcggcttgtagaagccggtgaggcagttgaacactgtggtcttgccggcgccgttggggccgatcagtgctacaacctgtttctctttcacggtcagggctacaccgttgaccgccagcaagccgccgaagcgcatgctcaagttttctactttcaggatctcgcggctcatttgcgcagctccatatgtggacgttgcatgggcagcaggccctgagggcgccagatcatcatcagcaccatcaaggcgccgaacatcaacatgcggtattcgctgaactcacgcatcatttccggcagcaggatcatcacgatcgccgccaggatcacgcccagttgcgagcccatgccaccgagcaccacgatggcgagaatgatcgccgactcgataaacgtgaacgactccggggtcaccaggccctggcgcgcggcgaagaagctgccggcgaaaccggcgaacgcggcgcctagggtgaacgcggaaagcttgatgatggtcgggttcaggcccagggcacgacaggcgatttcatcttcgcgcaacgcttcccaggcgcggccgatgggcatgcgcagcaagcggttgatcacgaacagtgccgccagcgccagcaacagcgccaccaggtacaggaacaccactttgctgaccgggttgtaggcaatcccgaagtattcgtggaaggtctgcatgccttcggctgcggtacggtcgaacgacagcccgaagaacgtcggcttggggatgctgctgatgccgttggggccaccggtgatgtcggtgaggttacgcaggaacagacggatgatttcaccaaagcccagggtcacgatcgccaggtagtcaccgcgcaggcgcagcaccgggaagcccagcaggaagccgaacgtcgccgccgccataccggccagtggcaggcagatccagaagctccagcccaggtagtgcgagagcagcgcgtaggtataggcacccacggcgtagaagcccacataaccaaggtcaagcaggccggccaggcccaccacgatgttcaggcccaggcccagcagcacgtagatcaggatcagcgtggcaatgtcgaccgcaccgcgggaaccgaagaacggccagatcagcgcagcgataatcaggccgatgatgatgtagcgctgggtacgcggcagggtcaggaattggctgaccttgggcgacaccagcgggccacgattgcccttgaacaaggcaccgacctgctgggtgaacagcacgcgcaggaacatcagcaccgagcacagggcgatgacggccaaggtcacgggaccggtgccatgcacttccaggttgatgccgacaatgctcagcttgaggccgagtaccggaaaggccacggcccataccagcaaggcgctgaaaaacgccgatttaagatatctgctcatactttctcaacctccggacggcccaggatgccggtcggacggaacaacagcaccagaaccaacaggccgaacgccacgacgtccttgtactggtcaccgaagatatcggcgccaaaggcttcggccacacccagcaccagcccgccgagcatcgcgcccggaatgctgccgatgccgcccaataccgctgcggtaaaggccttcaggcccaccaggaaaccggcgttggggttgatcacgccgtattgcatgctcagcaacacggccgccacggccgccagtgcggcaccaatgacgaaggtcaaggcgatgatgttgttggtgttgatgcccagcaggttggccatcttgatgtcttcggcgcaggcccggcaggcgcgccccagacgggagcgggagatgaacagggtcaggcccagcatggccaccagggtgacgacgaagaccaggatctgcatgtacgaaatcagcacttcttgtgcgccacctgggccgaaggagatgctccccgggatcaggttgggaatggacttgtccttggagtcctgggacagcaatacggtgttctgcaggaaaatcgacatgccgatggcggaaatcagcgggatcaaacggttgctgccacgcaagggacgataggcaaccctttcgatactgtagccataggcactggtcacgatgatcgacgccaggaacgcagcggtcatcaacagcggcagggagtggatccccatcatggccagcccggcgagggcgatgaaggccacgtaggaaccaatcatgtacacctcgccatgggcgaagttgatcattccaatgatgccgtaaaccattgtgtagccaatggctatcaaggcataggtgctgccaatggtcaggccattaaccagctgttggaaaaaatgatagatctcaggcattacagcgctcctaaaaacccgatacgcatttcactggtggagtcatttccggctggtgccctgttctgtgagcaggttgcacaaagcgtttgccagcgaaccgctggtgacggttttaagattttcaggtgagccagcgcccggatcgcgggtgacatggcccataaacctcgtaaaacaaagcccactgcttgcacagtgggcttgttgaccagtaacgcctggcttactgaggggaaacttcggtttttggtttaccgaagtgccattcgtagaccacgaatttgaagtctttcaggtcgcccttggcgtcaaagctcagatcgccggtaggggtcttgaaggtgcccgcgtggatggcctcggccaccttggcggtgtcttcgctcttggccgctttgatgccgccagcgatgacttcaatggccgagtaggccgggaacacgaacggaccggttgggtcctgcttgttcttggcgaactcttcgacgatggctttgttggcagggtcggtgtcgaaggacttcggcagggtcaccagcaggccttcggaagcgccctgggcgatttgcgagatggagtcgttgccgacgccttcagggcccatgaacttggcgttcaggcctttttccttggcttggcgcagaatcaggccaagctcagggtggtagccgccgtagtagacgaagtcgacattggcttgcttgagtttctggatgatcgaggagaagtccttgtcaccggcgttcaggccttcgaagacggcaaccttggtgcctttctcttcaagggttttcttcacggcgctggcgatgccttcaccgtattgctgtttgtcgtgcagcacggcaacgatcttcggcttcacgtggtcggcgatgtagttgccggccgctgggccttgcgcgctgtcgaggccgatggtgcggaagatcagcttgtagccacgggaggtgatttccgggctggtggcggctggggtaatcatgatgacgccttcgtcttcataaatgtccgacgctggctgagtggagctggagcagaggtgaccgactacgaacttgacgccgtcgttgaccactttgttggcgacggccacggcttgtttcggatcgcaggcgtcgtcgtattccttggcttcaagcattttgccatcgacgccgcccttggcgttgatgtcggcgattgcctgcttggcacccatgaattgcatgtcaccgtattgcgtcaccggaccggtcttgggaccggcgatgccgatcttgatggtgtcggctgcgaacgaatggccggcaaccccagccaggaccatagcggcaaacagtttggaaatctgcttagtagccttattcatagtgctccactcttactgttgtattttttatagttctagcggccttgtgagctgcagaaccggatcagatatcgcggatatccccccggcattgccctggcaactgtaccggtacagtgtagagcgccggttgatcgcttgaaaagctggcagctgggggcataccactgctatgtcgcttaaatgaaagaaaaagacagaattgcggcgggttcttatcagccttcaaggcattccttggctttcctggcactttcaatcgctacctcatttgctactgggtttttctacctgggttacgaggctatgattgcgccgattttttattcaggtgaactcccatgacgcaagaacctagcaccctctatgccaagctgctcggtgaaaccgccgaaatttcctggaaggagctcgagccgttctttgccaagggtgccctattgtgggtcgacaccggcctggatctgatcgaagcggccgagggaatggccgaagacaaccgtgacaaagtcgccgcctggctggccgcggggagccttggcgaagtgtctgcaacgcgggcattggacttggtggagcgtgatccgagcctgtgggcggtggtggtgtcgccttggattctgatccaggaaagggcagcttaagaattgcctgcacgaaaaaggtgcgtctttttaacccctgcaagtgtgtagcggagtaaccgcctagccggtgatggcaccttgccgtagagaaaggtcacagccgagggtgacgtaaacgtcacgggaacagttgataccgaggggaaagcggggatgaattgtttccaggtgtgccaaagcgctggatgccagcgactgtcgcaccgtcgatccgaacgattcggtctcagcgaatcggcctgacgatagaaggcgggccgatgcgcgccggcgcagggtcgttcggcggtggggtgtccgtggcgccttccacgctgaatgggtaaagcgggttgcgcagcgcaatgccttgaatcacgccgatgatctcgttgaagggcaccgccgggctgagcaggtagccctggatatagtcgcagccatgtctgagtagcagctcgaattgctcctgggtttccacgccttcagtgaccacctgcaagtgcagggtgtgggccatgccgataatcgcctggacgatttcgctgtcggctctggaccttggtatgtcctggataaacgagcggtcgattttcaaggtgttgagtggcaagcgcttgaggtaggccagggatgaatagccagtgccgaaatcgtcgatcgccagggagacgcccaacgcacggatttgccgcaacagcgccagggtgctgctgatattgcccatcagtgcattttcggtgacttccagttccaggcggttggcagccacagcagcgaagcgcagggcggcttcgatttcatcggccaactcgtcccgggccaggttcagcgccgagcagttcaccgccatggtcagttcggtgtagcctcggtcagacagcaggctcagatcatgacaggcctggcgcagtacccagtgatcaagctccgcgatcagcccgttattctcggcgatgccgataaagcggtccggtgccagtagcccgtgctgcggatgctgccagcgcaccagggcttccaggcgcgtgaccttagcgagcttcatgtcgaagatcggttgatagaacagcaccaacccactgcgtgcgcgcagggcagcgcgcagctcttcttccagctgcagttcgaggaacgcgcgggttttcaggttggagctgaagaagtgcaggctgttgcgcccggcatccttggattgataaagcgccaggtcggcggttttcaacagttcttcgcaggtctggccgtcgtcggggaacaggctgatgccgatgctggtggtcatcaccatacgtcggccggccagttcgatgggttctttcattttctgcatgatgcgcagggccatatgccgtgcttcgtcgcggtgatgaatattgatcaggatgcagaactcatcgccaccaaatcgtgcgacgacatcctcatggctgcgtaccgagcttttgatatacccggccaatacggtgagcaactggtcgccagcatcgtgcccaaggctgtcattaatgcgcttgaagtgatctatatcgaggaagatcaccgccatcatccctttgtttcgcgttttttctacgagtttttccgcgaaaatctgattgaacccgcggcggttgagcagattggtcaatgcatcgaagtgggccacctgttgcagcgaggcgcgagcctggtccagttcgctgagcagcgcgttgacccggcgcaggtcatgctccttgtgttgcagttttttatccgccagggctgcgctgatactgctgccgatcaccagcaaagtaatcaccgccaccgacaggcccagttgaatcgggttgttatctaccggcagcgacaggtccgcatcattgagtaccagcatttgcatggcggccatgcctgtgaaatgcatgctcaggattccggcgcccagcaccaggctggcggcgtatttgagcaattgatgaaagaccccggcaccgttacgcaggtaactggacagcagcaacgccgccaggctggcaccgatggcaatcgccaccgacgccatgaacagtcgcgattcaacgtacacctgggcctgggagcgcatggccgccatgcccacatagtgcatcagtgcgatgcccaggcccatccacactgaggccagcaggtattggtggggccgcacgtgggcatgactgagggtttgcatggccaatagcgcagcgatcagggcgatcagcagggaagcgaaggtcgtgagaagttcgtagtgaatggcgacaggggcctggaaggccagcatgctgatgaagtgggtcgaccagatcccgcccgccaggcaacccgctcccagccagcaccaatgacggcgggcggtggggttttcgacatggccgacgcgttcggccatgtctagcgtaccgaaacccgctgcgcaggcgaccaggtaggcgagcagcaccagaaaggggttatgactgcaattgagtaataaatgcccgctgtctggaaggtcggtaaaaaaatgctgacccagccattccatagcttatcccatcttggagccacgtcactgccagaggcgatgacctatgacgtcgagtatagaagcctcgtggcatttgccatgaataatggcactttgatttcaatgattttggcatgcgacacatagcgtttggtgctaagcactgatgggcaattccagttcgaagtgttgctcctcaagggggggcaggccgaacgcggcgcgcgccgcatcgcagtcgacattttgcaccccctggctccaggaagaatcgaactcgcggcatacgctggaacgctgttcatagatcgagcaactggttgcctgcccaacctcaccttcaaggctgcaacaccgcgcgggcttctggtcggtaccgatcattgccactcggctggggttgatctgcaccaccaggtcatcgggcaccgtacccccggatgaggcgcactcgccccaaaagaaagacacacgaaagtgtgaacagcaggcaccgcaattcagacacggactggcttcggacatgggcgtcatcgataagaaggtaagaggagggtgcaacggaaggctcgccattctatccgtgccaaggccattgggaaggggggcaagcacttatatttttgtgggtgaaatcccgcgttatcgggtgaaatcatgccctatcagctttacgaatcattacagacaaccgctgccagcctgattatgttgcaggtaccgggcaggatgcgtcgggcatcgcagctctcataacaataaaagagacggacccatgcagaactcgacccaagcggcgaatgcctggcgcattctgttcctgctgttcctcgccaacctgttcaatttctttgatcgcaccatccccgcgatcatcatcgagcccattcgcatggaatggcacctgagcgacttccagctcgggatcatcggcaccgcctttaccattgtctacgccatcgccgggctgccgctcgggcgcctggccgatactggctcacgcagcaaattgatgggctggggcctgttcgcctggagcgggctgacggcagtcaacggcttggtcggcagtttctggagcttcctgctggtgcgcatgggcattggtattggcgaggccagctatgcgccggctgccaactcgctgattggcgacctgtttcccgcccaccgccgtgcgcgagccatgggcattttcatgctcggtctgccgttgggcctgttgctggcgttctttaccatcggctggatggtcaaggctttcgacagctggcgtgcgccgttctttatcgcggcggtgccggggctgatcctggcggtgttcatgttctatataaaagaacccaagcgcggcgcggcggaaaccgtgcaagtctcacaggagcgcgtcgaccgcccgatccgtcgcgtgctggcggtgccgacctttctctggctggtgctcgccgggctgtgctttaactttgctacgtatgcgtgcaactcgttcctggtgccgatgctgcaacggtattttctgatgccattgcaggatgcggctgtcgcgacgggtgtgattgtcggtttgaccggcctggtgggcttgaccctgggcggctggattgccgacaagattcatcagcggatcgccaatggccgtctgctgtttgccgcgtgcagcttgattatctccacggtgactaccgcctgggccttgcatgccggacgtatagaaattggcgtgtttgtcgcgctgttcagtgtgggctggttgtttgcctacaacttctacacttgcgtttatacggcgatccaggatgtggtcgaaccgcgcctgcgcgctacggcaatggcgctgttctttgccggtttgtatttgctcggcggcgggatgggaccgattgtggtgggcgggctgtctgatcactttgcccattcggcaatgtacgcggcgggagcggagcagatgactgaggcttataaagccgtggggttgcatgacgccatgtacctgattccggtggcgctgttcttgaccatgctgtttttgttccaggcgtcacgtagttttgtgcgcgatgccaagcgcatgaaggatgggctgagtggagttcaagtgccggcttctgcggtaacggcatgagaccgaggtgaccctatcgggggcaagccccctcccacatttgaccgagttgtctgaaccctactcggtcagtgtgggaggggcttggccccgatgaggccctcaggaccaataaaaaaggcccgcactaagcgggcctcctcattggcagcgaatgatcaacccgcgaccaacacccgaatcgcttccaagcgcagtgccgccttgtcgagcatggccaggccttgctcgcgttgattgcgcaaggcaaccagctcgctgtcacgcacggtggggttgaccgcttgcagtgcggtcaggcgcgccagttcttcgtcggtgtccgccgccaggcggcgcttggcctcggccacacgctcggcgtggcgcggggcgatcttctcttcaccggcgttgatgcgcggcgtgagctggtcgcgctgggcctgtacgaacttgttggcgctggcccgtggcacgctttccaactggtcgttcaaggtcacaaacgacacgcgacccgagaggtcgttgccattggcatccagcaggcagcgcagggcggccggtggcaggtagcggcccagttgcagcgagcgcggcgccaccacttcgctgacgtagagcagttccagcaacacagtgcccggtttgagcgccttgttcttgatcaacgccacggcggtgttgcccattgagccggacagtaccaggtccatgccgccttgcaccattgggtgttcccaagtgatgaactgcatgtcttcgcgcgacagtgcctggttgcggtcgtaggtgatggtcacaccctcgtcgtcacccagggggaagctggcgtcgagcattttttcgctgggcttcaagatcagcgcgttttccgaatggtcctcgctgtcgatgccgaaggcgtcgaacagggtttccatatagatcggcagggcgaactggtcgtcttgctcgaggatgtcttcgaccagcgcatcgccttcaccggcgccgccggagttgagttccagcaagcggtcacgaccggtgtgcagctcctgctccaggcgttcgcgctcggcacgggcttcgtcgatcagggcttgccactcgccgtcgtcggcagcttccagcaatggcagcaggcgcgggccgaactgatgctgcaaggcgttgccggtcgggcaggtgttgaggaaggcgttgagcgcttcgtggtaccactggaacaggcgctgttgcgggctggtttccaggtacggtacgtgcagctcgatcacatgtttctggccgatccggtccagacggccgatgcgctgttccagcaggtcggggtgggacggcaggtcgaacagcaccaggtggtgggagaactggaagttgcggccttcgctgccgatttccgaacagatcagcacctgggcaccgaactcttcatcggcgaagtaggcggcggcgcggtcacgctcgaggatgttcatgccctcgtggaacaccgtggccgggatgccggagcgcacgcgcagggcgtcttccaggtccatggcggtttcggcgtgggcgcagatcaccaggaccttggtgcgcttgagcattttcagttggtcgatcagccactcgacccgtgggtcgaagcgccaccagcgattttcttcctcgatgtccggttgcgcctgaaagctgacttccgggtacagctcggcgtgctcgcccaaaggcaattcgaggtattcatccgggttcggcagcgggtaggcgtgcagcttgcgctcggggaagccctgcacggcggcacgggtattgcggaacagcacgcggccggtgccgtgacggtcaagcagttcacgcaccaggcgggcgctggcttcgctgtcgccatcgttgacggcggtgagcagggcttcgccttcgttaccgaggaaaccctggatagtcttgtgcgcggccggtgacaggcggcccttgtccagcagttcctgcacggcctcggcaaccgggcgatagttctcgctctcggcgcggaaggcttgcaggtcgtggaaacggtttgggtcgagcaggcgcagccgcgcaaagtggctgtcctgaccgagttgttccggggtggcggtcagcagcaggacgccgggaatgacctcggcaagctgctcgaccaggctgtattcggcgctggccttgtcttcatgccacaccaggtggtgggcttcgtcgaccaccagcaaatcccagccggccgcaaacagcgcgtcctgggccttctcgtcatccaccagccattccagcgcaacgagtgcaagctgggtgtcttcgaacgggttggtggcatcgctttcgataaagcgctcttcatcgaacagcgcgacctgcaggttgaagcggcggcgcatttccaccagccactggtgctgcaggttttccgggaccaggatcagcacgcggctggcacggcccgagagcagttggcgatggatcaccaggccagcttcgatggtcttgcccaggcccacttcgtcagccagcaagactcgtggcgcgatacggtcagcgacttcacgggcgatgtgcagttggtgcgcaataggttgcgcgcgtacgccacccaggccccacaatgatgattgcagttggcggctggtgtgttccagggtgtgatagcgcagcgagaaccaggccagcgggtcgatctgcccggcgaatagacggtcgctggccaggcggaactggataaagttggacagttgggtttccggcagggtgacctgctcgttctgcccgttgaggccgtggtagaccagcaggccatcgacgtcgtcgacttcctgtacggtcattttccagccttcgaaatgggtgatggtgtcacccggcgaaaacctcacgcgagtgaggggcgcattccgtagcgcatactggcgggtgtcgccagtggccggatagagcacggtcaacaagcgcccgtcctgtgccagaacggtgcctaaccccagctctgcttcgctgtcactaatccagcgttgccccggttgatactgctgcgccatgctgcctgactcccgccgtgaaaaagccgactatcttaacggaacaagcccctgcgcccaaggactctgacaaaaactacgctgtttgtgaggtgcgccgggagttgaatcgacgggtggcgggcacttgcgagtgtcgactgggtcacagcttggcacgccggtgctcaagtcgccttgccatccgccgacagcctgttgatcaggagaataactatcatgcttccacccatgctgcccgtcagtgttgtgccggtcacgtcgcaactcgatccggcacgccagaagccggatattccgccggtggtccccgttcaaccgggctccaacgagagcaccatcgacctgaagaagggcgatgccgagcaatcgacctttctgctgcgcgaagaacaacgtcgccagcaagagcaacagaagcgccagcgtgaagccgacgatgaggcgcagcagcacctgcccattcccggcgacctgctcaacgctgacaacactgttcccgtggcgccgctgatcgaagatgcgccgcgccagggcctgtgggtggatatcgaggtttaatcgatcagttcaaccagggccgtcatcagccgctcgatgtcatcatcggtgttgagcgggctgacggatattcgtgcaatgcttgccagcccgcgtgcttgcatatccagcggcgtgtaggcgataccattggcgccgatgttgatgcgcttcaatcccaggcgccgcttgagttcaaagctatcccagccagccaggttgaaagcgatcaaacctgaatgcgtggtgcccaagtcgtgcagggtaatctgcggtagctgacgcagtgcttcgcggattcgtgtgctggtctgcgagaccctctcccacacccgctcgatcccccatcgattgatctcttgcaacgcattgcccaagcctgccagcaaggcgaaggacacttcgctggtttcgaaacgccgggcgtcgttgcgcaagtcgaagccctcggcagtccagggcgctgaaaacacgtcgcgctggacggggttcaggtgctggagaaaatcaggccgtatatagagcaatgcggtaccgcgaggcccgcgcaggtgtttgcgaccagcggacttgagcacgtcgcactgcaacgcttgcacatccactggcacctggccgacggcttggccggcgtcgataaagtaggggatggcatgccgtcgggctaccgcgccgatggcctgggccgggttgatcaggccactgttggccggtagccaggtaaggtcgatcagcttcacatgggcgtcgagcattgcctcaagtgccaccgggcagaccgcgctggcggcgtcacaggggatcacctccacctgcgcgcccgcttgcacggccagcgccatgctcgccaggttgccgccccattcatggcggcccaccaggatgcggtcgcccggctgccaaggccccaacgcttggaacgccatgctccaggccgtggagccactgctggtgaaggcaatcgacgacgccggcgcattgagcaactgtccggcggcgcggcgggctttttccaccagcacggcgccccgttcgccagcctccatcgggccgtcgcgggcctcacaatgcaactgctcgatgatggcgtccagtgtcgcctggctgggcaaggacgctcctgcgtggttgaaatgcacgatgcccgactgacagccgggcgtggtgtcgcgcaattgctggatgtccagcgcgctcacggttgcagctcgaaaatggcatccacctcgacggcgacgccggcaggcaaactgcagacgcctatggcggtgcgcacatgtcggcccttatcgcccagggcattgaccagcaggttcgaggcgccattggcgaccacgctctggtgctggaattcggcagtgctggcgatgaatacgcccaggcgcagggtacgcgttacacgcgacaggtcgtcctccagcgcatcgctcaattgccccagcaggcccagcgccgccagttccgccgcgtgggtgccttgttcatcgctgagggaatcgcccaggcgcccgatgtaggccggtttaccatcgaccaggggaatttgtccggagataaacagttggtgttggctgatgacatggctgatgtagttggccgccggctggctgggcgttggcagtatcaggccgagggcgtgtacgcgttggcggatggaatcggtcatggtaaagcctccaggttcaggaggtttgagcatgtcgattgacgcgatggccgacaaacggatagatctcaatcgacgtatcgaaaaaactcacgcgtttgcgcaggtttgcttgagccactggctgaaacactcggccgcttggctgagcgggccttggggtgcgatcagccaatagccgatttcactgtgatagggcggccagtcaaacgcctggaccaggctgccttcctggagtctgcgctcgatcaggcgatggcggcccatggcgataccctggccggccacggtggcttcgaccacaatgttgtagtcatgcagcatgacgcgggggtaggggctgaggtcgacccggtaatgggcagaccagtccgtccattcgaaagggcggtgcgaagttgccatcaacaaggcgccatggggcatctgcctggccttgaaacccgggctgcacaccggggacaggatttcgggcatcaggcgtgtggcctgcacgtcgggccaatcgcccttgccgtaacggatggccaggtcaacctcggccgtggcgacgttggccagttggatcgcgggcagcaactctacctggatgtgcgggtagcgctgcagaaagtcggccaggcgcggtgccagccatagcgtggcgaacgacgccagcacgccgatgcgcagtacgccggcgctgggggccacacgttggctgcgagttgccgcgccgatggcttccagggccgggcggatttgatcgtagtagtgttgcccgtccaatgtcagatcaatcgcacgggtacgccggataaacagcggcttgcccaaatgctgttcgagcttgtgcacctgatggctcagcgcgctttgggtcaccgacaactcgtccgccgccttgataaagctcaagtgccgcgccacggcttcgaaggcgcgcagggccagcagcggtggaaggtcgttgtgcaaggccacctggatgcgtctcctgggtcgagtggaaggtgccgattttggtcgatgccctgcattttgtcgcccgctgatttgccgtggggcggggcaggccgcattattggggtattcccgccacgacgtaagccaagccatgagtgatgacgataagctgattgacctgaatgccgaacgcgccaagcgtgtacacgacctcaatgacaaacgcttgaatgaagtgcgccaagcctttgaacaagccatgcccttgggaaaaaccaagaagaagtcgaaaaacaaaccgaaaaagcgttgaaacagcctgcatccattgatgcaggtcagttattacccttctttacgccctcttatgggcgacattgatcctgatcaatttcccactgcgccttctccattaacttagccctatcgcaacagggcaagtgcaggaggccggtcatgtttatcgataatgtggtttttgccggagtgctgactgtaagcctcatggtgctgttttttgtagggtttggattttttatctggaaagacgcgaacaagcgtaaaaaaccttaggtttttccggattacatgggcacgcaaggcattttgggcgacttcggtcgcccttttttttgctctgcttttctctaaccgcgaatataaaaaaaggtgcgaccctcgcggatcgcaccttttttatggccggctggctatcagttgcccaatgccttggacgccagccagaacaacccggccgacaggcccacggtcgccggcagggtcaatatccaggccatcaagatggtcttgacggtgccgccttgcaggccgctcttgttggcgaccatggtgcccgcgacgcctgaagacagcacgtgggtggtggacaccggcagagcgaagatattggcgaagccgatcatggtggcggtggtgatctgggccgacatgccctgggcataggtcatgccctgcttgccgatcttttcgccgatagtcagtaccacgcgcttccagcccaccatggtgcccaggcccagggcgagtgcgaccgcaaggatcacccagaacggggcgtactcggtggtggcggtcaggtctttgcgcagcttgtcgaggtcggacttctcacgggaatccaggcctggcagcttgccgactttcttcgcggtgtcgtccaggcagagcaggtagcgacgtacttcaatgcggtggtcggcagtcagcgagtggtagtccgaaacgcctttcaaggtgcccagcagcgcgttgatcgtcggttcggtctgctgcgggttgcagcggaacttgcccggcaggtcatccttcacgcttttgcccagggccaggaactcgcccagggtctcgtggttgcgctggtagaactggttcaagtgcagggtcgcgtcgcgggtacgctcgatctggtaggtggtgctacccaggtcaaggacgaactgcgccggcacgataccgatcagcaccagcatgatcaggccgatacctttctggccgtcgttggagccgtgtacgaagctgacggccatggccgaaatcaccaggaccaggcggttccagaacggcgggtgtttcttgtcgtctagcttgcggcgctggtccggagtcttgtgcatcttcgacagcgggcgccaccacttcaggccgatcagcaccagggctgcgaccagaaagccggccatcggcgagaacaccagggacgcgccgatatccacggctttctgccagttcacaccgtcagccagggggatgtcgttgatcagggcattggccaggccgacaccgaggatcgagccgatcagggtgtgggagctggaggcggggataccaaagtaccaagtgcccaggttccaggtgatcgccgcagccaataaagagaagaccatcgccaagccatggccggtgttcacattgatcagcaactccaccggcagcaaatgcacgatggcgtaggcgacaccgacaccaccgagcaatacgccgaggaaattgaacaccccggaaaagaacacggccaggtgtggcggcatggctttggtatagatgactgtggccaccgcgttagcggtgtcatgaaagccattgatgaactcgaaggcgaggacaaaggccagggcgagcaacaggctcactagaacccaagcatccagtccgctgaataaatcgatcatgaaggttttctgacccggtcgtaagggggcgcgattatgccagaaaacatcggtaatcgatgcattagctgctcatcggtaacaatcttcattgaaaaacccgcgccaggatggacgcatcccagggttttcggggctttggcaagtctttgatttataaagctcaggccggaaaagaccggcgttggtcatgaaaatgtcatgcctgaaacatttgtatgaaatttcgttggcggccgtaggttactgaccagcgggcggtgcgccatggagccctctgccagtggtggaccggcagagacagcagaccctggaagctcgaacgcaagtgcttatggctcttcagtcttgagttcctgttctatcttttggatttcctgggcaaaggcttggtcgagcaggctggctcgcttgcgccatggcttgcgttctggctcaggttgcgcggcgtaggtggtgacttccccgccgtagacgtccttgtaacgttgctcctggcgctcaagttccgcgcgcagttcatctttcgtcacagtgttacctaattgagttaagtttattgattgcgcagcgtcatgcctgaaagtcgtcctcggatggtttcaggttgaacagtcgaactgttcaacttggaatgcagacctgagggcagttcttttaagcgggtattgtgaccgtcgctgcatacatcccgcagcgcctggcgagctccaattccgatagtgataccgggctgacctctgcacaggttgcattatagcggcgcatttgaataacactatcactacgaagttaaaaagcgtcaacgttgtgtgagggttttattacatgcgggcgccagtatttgtgaacgccgtcatcctaatgtctacgttcattctaaagggcagggtaaacggccacattttttggatttatcaggcaaatctgaaacgttgaccacgggcgcgccagtgcgggtcaaattgcgataatcgcatgattgtccgataatcgcccaatgttgccggcgctgtcttgtgcatcgcgtccggcacggcttgtaatggcggccaaccctcccgtggtgaaaacaagagaaaggacccctgaaatgaacgatcaattgcgcaactcctttgcatcagtggcgccgccgatcgtggcatcaccggccaagcgcatccaggccttcaccggtgatccggatttcatgacctccctggcccgtggcctggccgtggtgcaggcgttccaggaacgcaagcggcacctgaccatcgcccagatcagccatcgcacggaaatcccccgcgccgccgtgcgtcgttgcctgcataccctgatcaagcttggctacgccaccaccgatgggcgcacctactcgttgttgcctaaagtgctgacccttggtcacgcctatctgtcgtccacaccgttggccgtgtcggcccaaccctatctggaccgcatgagcgagcagctgcatgaagcctgcaacatggccaccctcgagggcgatgacatcctctatatcgcccgttcggccaccacccagcggctgatctccgttgatttgtctgtgggtgggcggctgccggcgtattgcacgtccatggggcggattttgctggccgctctcgacgatgcttcgttgcaggactatctccagcatgccgacctgcaaaccaagaccagccgtaccttgaccacgcctgaagccctgttcgaatgcctgcaacaggtccgtcagcaaggctggtgcattgtcgaccaggaactggagcagggcctgcgttctattgcggtaccggtgtatgacgcgtctggccaggtactggccgcgctcaatgtcagcacccatgccggacgggtcagccgcagtgagttggagcagcgctttttgccgagcatgctcagcgccagccgcgagttgagtgcgcagttgtttgcctaagctgttcggtgaccgcacagatcccggttggctcgattgacggtgtttcccctggcttattaatgtgcggcagcgctctgaggagctgcccaataataatgatgacctgaggtcgtcagcccgccatcggtgtggaataaaaataatgaatcagccttctgtcggtaccaccctggacgtgcagtccttcatcaatacccagccactgtcacgctatcagtggcgcgtggtcattctatgtttcctgattgtctttcttgacggcctcgatacagcggccatgggctttatcgcaccggcactgtcccaggactggggcatcgatcgcgccagcctcggcccggtgatgagcgccgcgttgatcggcatggtgttcggcgcactgggttccggcccgctggccgatcgctttggccgtaaagtcgtgttggtgggcgcggtggtggtgtttggagcgttcagcttggcgtcggcctacagcagtaatgtcgatcagttgctggtgctgcgctttctcaccgggctgggcctgggcgccggcatgccgaatgccactaccttgctctccgaatacacccccgagcgccataagtcgttgctggtgaccagcatgttctgcggcttcaacctgggcatggctggcggtgggtttatttcggccaagctgatccccgccttcggttggcacagcctgttgctgattggcggcatcctgccattgatcctggcgctggtgctgttggcgtggttgccggaatcggcgcgttacctggtggtacgcaatcgcggcaccgacaaggtgcgcaaaacccttgcccccatcgagcccggtatcgtcgcccaagccagcgctttcagcgtgccggagcaaaaaaccgtcaaggcccgcaatgtgttcggggtgatcttctcgggcacctacagcgccggcaccttgctgttgtggctcacttacttcatgggcctggtgattgtgtacctgctgaccagttggctgcccacgttgatgcgcgacagcggcgccagcatggaacaggccgcgtttatcggcgcgttgttccagtttggcggggtgttgagtgcagtgggcgtgggctgggcgatggaccggttcaacccgcacaaagtgatcggtaccttctatctgttggccggagtgtttgcctacgcggtcgggcagagcctgggcaatatcacgctactggcgaccctcgtgctgatcgccgggatgtgcgtcaacggtgcgcaatcggcgatgccgtccctggccgcacggttctacccaacccaggggcgtgccaccggtgtgtcgtggatgcttggcattggccgcttcggcgcaattctgggcgcatggatgggcgccaccttgctgggcctgggttggaatttcgagcaggtgcttacggcactggtgatcccggcggcgttggccacggctgcggtggtgatcaagggcatggtcagccatgccgacgccacctaagcctggcggggatcaaatgtggggggcttgcccctcccacatttgaaggttagctaggtaacaatctgttcgtttatcgaacactgagtcgattatcggattgtttgccccctatccccggcttaaccttcaagcacttcggcgccccctcagcgccttttttgatcaacagcgggagcccaaccccatggctgaaatcctcactctgcgtgatgcggtcaagcgcttcgtgaacgacggcgataccgtcgccctcgaaggctttacccacctgatccccacggccgcaggtcatgaaatcattcgtcaaggcaaaaaagacctgacactggtacgtatgacccctgacctgatctacgaccagttgatcggtgccggctgtgcgcgcaagttgattttttcctggggcggcaacccgggtgtgggctccctgcatcggctgcgcgacgcggtcgagaagcaatggccgcagcctctggagatcgaagaacacagccacgccgacctggccaatgcctacgtcgccggggcatcgggcctaccgttcgcggtactgcgtgcctacgccggttctgacttgcccaaggtcaacccactgatcaagaccgttacctgcccgtttactggtgaagtgctggcggcggtaccgtcggtacgtccggacatcaccgtgatccacgcacagaaagccgatcgcaagggcaacgtgctgctctggggcattctcggcgtgcagaaggaagcggccctggcggccaagcgctgcatcgtcaccgtcgaggaaatcgtcgatgacctgaatgcaccgatgaacagctgcgtgttgccgacctgggcgctgacggcggtgtgccacgtacccggaggtgcacatccgtcatacgcccacggctacaacgagcgcgataaccgtttctaccaggcgtgggacccgattgcccgcgaccgtgaaacctttaccgcctggatcgacgaatacatccacggcaccgccgatttcaatgaattccgggccaagctggccaccgcgcaggaggccaagtaatggcttactccactaatgaaatgatgaccgtcgccgctgcacgccgcttgcagaacggctcggtgtgcttcgtcggcatcggtctgccgtccaaggccgccaacctggcgcgcctgacttcatcgcccgacgtggtgctgatctacgagtccggcccgattggggccaagcccagcgtgctgccgctgtccatcggcgatggcgagttggcggagaccgccgacaccgtggtgcccaccggtgagatctttcgctattggctgcagggcgggcgcattgatgtgggctttctcggcgcggcccaggttgatcggttcggcaatatcaacaccaccgtggtcggtgactatcaccagcccaaggtgcgtttgcccggtgccggtggcgcgccggagatcgcaggttcggccaagagcgtgctgatcatccttaagcagtcgtcccgttcgtttgtcgacaaactggacttcatcacctctgtcggtcacggcgaaggcggcgactcacgcaagcgtcttggcctgcccggcgcaggacccgtaggcatcattaccgacctgtgcatcatggaaccggaggagggcagccatgaattcgtggtcaccgcgctgcatcccggcgtgacccgtgaacaggtagtggccgccaccggttgggcgattcgctttgccgaccaggtcagcaccacggctgaacccaccgagacagaactgaccgccctgcgtgacctcgaagcacgcacggccgcggcccacggccaagcgccgggagaagcctgatgcgcgacgtattcatctgtgatgccattcgcacgcctatcggccgttttggcggcggcttgtcgactgtacgcgccgatgacctggcggcgctgccgatcaaggcgctgatcgagcgcaacccctcggtggattggaatgcagtggacgaggtgttcctcggctgcgccaaccaggccggcgaagacaaccgcaacgtggcgcgcatggcactgttgctggcggggctgccggaaagcgttccgggcgtgaccctcaaccgtctgtgcgcctcgggcatggatgccatcggcacggcctttcgcaccatcgccagcggcgaaatggagctggcgattgccggtggcgtcgagtcgatgtcccgtgctcccttcgtgatgggcaaggctgatgcggcgttttcgcgcaacatgaagctggaggacaccaccatcggctggcgctttatcaacccgctgatgaaggcccagtacggtgtggatgccatgccgcagaccgccgacaatgtcgccgacgactatcaggtttcccgcgccgaccaggacgctttcgccctgcgcagccagcagcgcaccgccgccgcacaagccgccggcttcttcgccgaggaaatcgtgccggtgcgggtcgcccataaaaaaggtgaaactgtagtggagcacgatgagcacccacgggacaccagcctggaagccctggccaagctcaagccagtcaacggtccggacaagaccgtcactgccggcaacgcttcgggcgtgaacgacggcgctgcggcattgatcctcgcgtctgccgaagcggtaaagaaacacggtctcactgcccgcgcccgcgtactgggcatggccagtgccggtgtcgccccgcgtgtgatgggtatcggcccggtgcctgcggtgcgcaagctggtggagcgcctgggtttggcggtcactgactttgatgtgatcgaactcaacgaagcctttgccagccaaggcctggcagtgcttcgcgaactggggcttgccgacgatgccccccaggtcaacccgaacggtggcgccatcgccctcggccaccccctgggcatgagcggtgcgcggctggtcctgacggccctgcaccaattggaaaaaaccggcggcagcaaaggcctggcgaccatgtgcgtgggtgtcggccaagggctggccctggcgattgaacgcgtccaataagagaggattgctccatgagtgacaagcccggttaccggcgcccgcacgcgggtacccaacctgattacctgcacccggcctaccagtcgacgaacctgcgttcgccgtcccagccattggtgttcctgccccattccttgtcggaaatcaccggcccgatcatcggcgccgagcgtatcaatgagaaggacaacgacctgacggcccagcatgaaggcgagccccaaggcgagcgcatcatcattcacggccgcgtactcgatgagaacggcctaccggtaccgggcatcctcgtggagatctggcaggccaacgccgctggtcgctacaaccaccagcgcgacctgcacgatgcaccgctggacccgaatttcaccggcaccgggcgtaccgtcaccgacgccgatggctggtaccagttccagaccatcaagcccggcgcctacccatggggtaaccaccacaatgcgtggcgcccggcgcatatccacttttcgctgttcggccccagtgtgctgacgcggttggtgacgcaaatgtatttccccggtgacccgttgctggaatacgacccaatctacaactgtgtaccggataccagtgccaaggagcgcttgatcgcgcgattcgacctggaaaaaaccgttccgtcctacgccctcggttaccgctgggacatcgtcctgcgcggccgcgacgccacgccgatggagaaatgagatgacactctacgcaaccacgtcccacaccgtcgggccttattaccacatcggcctgacctggctgaaccgcgaagacctgacggtagccgcgaccctcggcgaacgcgtggcgatcagcgggcaagtgctggacggcaacggcgatgtcgtcaacgacgccatgttggaagtctggcaggccaatgccgccggcaaatacgaccaccctgaggatgagcaggacaaggcgcttgaccccaacttcgaaggcttcggccgggtgccggtagatgccgaagggcgctttcgctttaccaccatcaaaccaggcagtgtgccggggttgaaaggcacgacccaggcgccgcatctggtggtactggtatttgcccgggggctggtgaagcacttgctgacgcggatttattttgacggcgaggcgctcaatggcgatgacccgctgttggcatgtgtgccagcagagcgtcgcggtaccttgattgccaaggcggacgcgcagggtgtgcatcagtggaatgtgattttgcaggggacagacaaggaaacggtgtttttcgattactgagttggctgtaggcctcatcgggagcaagccccctcccacattgaatgtcacaagtccaaatgtgggagggggcttgcccccgatgaggcccttacagtcactgcatacccaaaagtctgcttgcggaacatggttgttgcaaagtatgtctaggctataaccgttcccactgagtgaaaaaacatgacaacaacaaccagccactacaccggagaagaacgcagcaaacggatttttgcgattgtcggtgcctcatccggcaaccttgtcgaatggttcgacttctacgtctacgcattctgcgcgatttatttcgccccggcgtttttcccctccgacgatcccacggtgcagctgctcaacaccgccggcgtgttcgccgccgggttcctgatgcggcctatcggcggctggttgtttggccgggtggccgacaagcacgggcgcaagaactcgatgatgatctcggtgctgatgatgtgcgccggttccctggtcatcgccttcctgcccacctataacgacatcggtgcctgggcgccggcgctactgttggtggcgcggctgttccagggcttgtcggtggggggcgaatacggcaccacggcgacctacatgagtgaagtcgcgctcaagggccagcgcggtttcttcgcctcgttccagtacgtgaccctgatcggcggccagttgctggcggtgttggtggtggtgatcctgcagcagatcctcaccgaagaagaattgcgtgcctggggctggcgcattccttttgtgatcggcgcgattgctgcggtgatctccctgctgctgcgccgcaccctgaaagaaaccaccagcaaggaaatgcgcgaagacaaggacgccggcagtatcgtcgcgctgtttcgcgaccacggcaaagccttcatcaccgtgcttggctacaccgccggtggctcgctgattttctataccttcaccacctacatgcagaagtacctggtgaacaccgtgggtatgcacgccaagacgtccagctacatcatgaccggggcgctgtttctgtacatgtgcatgcagccgctgttcggcatgctggccgacaagatcggccggcgtaattccatgctctggttcgccggccttggcaccctgttcaccgtgccgatcctgttgaccctgaaaaccgtgaccagcccgttcctggcctttgtgctgattaccctggccctggcgattgtcagcttctacacctcgatcagcggcctggtcaaagccgagatgttcccgccccaggtacgtgccttgggcgtgggcctggcctatgccgtggcgaacgcagtgtttggtggttccgcggaagtggtcgcgctgagcttgaaatccatcggcatggaaaacaccttttattggtacgtcactgcgatgatggcggtggccttcctgttcagcttgcgcctgccgaaacaggcggcttacctgcaccacgatctataagggacgagttatgacgctgcgcacgagcaatcaactgttcgacgcttacttcaccgccggcagcatggcggaagtgttctgcgaccagggacgcctgcagggcatgctggatttcgaggccgcgctggcccgggctgaggcccaggtcgggttgattccgcaggccgccgtggcgccgattgcccaggcttgcctggcttcgctctacgacgtggacgccctcggcgtggcgattgccacggcaggcaactcggcgattccgttggtcaaggcactgggcaagctgattgccagtgaagatcccggcgccgagcgctatgtgcatctgggcgcgaccagccaggacgtgatggacactggcctggtgctgcagttgcgccaggcactggggttgatcgaagcggacctggcgcgcctgggcgatgtgctggctgcccaggcccagcgttacgccgccgtgccattggccgggcgtacttggttgcaacacgcgacaccggtcaccctgggcatgaaaatcgctggttggctgggcgccgtgacgcgcagtcgccagcgccttgccgagttgaagccgcgcctgctggtgctgcagttcggcggcgcgtccggcactttggcagcgctcggcgaacacgccatgcccgtcgccgaagccttggccgctgaattgcagttgggcttgcccgaacaaccctggcatacccagcgtgatcgcctggtggaatttgccagcgtgctcggcctgatcgccggcagcctcggcaagctgggtcgcgatatcagcctgttgatgcaaacagaagcggcggaggtatttgaacctgcggcgccgggcaagggtggttcttcgaccatgccccacaagcgcaaccctgtgggcgccgcggtactgatcagcgccgccacccgcgtaccgggcctggtggcgacgatgttcagtgccatgccccaggagcatgaacgcagcctgggcttgtggcatgccgaatgggaaaccctgccggagatttgtcggttggtgtccggcgccttgcaacaggcggtgttggtcagtgaagggctggaggtcgaccccgagcgcatggcgcagaacctcgacctgacccagggcctgctgctagccgaagctgtcagcatcgtgcttgcccagcgcctgggccgcgacaccgcccaccatctgctggagcagtgctgcaaacgcgccgtgaccgagcggcgccacttgcgtgaagtattggcggatgaaccgcaagtgaccgccgagctgtctgcggctgaactggatcgcctgctcgacccggcccattacctgggccaggcgcacacctgggtcacccgtgcagtgaccgaacactttgccttgactgcctgaggagactgctgtggcttttgtacaactcgccgagggcgaactgcattaccaattggaggggcccgagggcgcaccggtgctggtgctgtccaactccctgggcaccgacttgcatatgtgggacatccagatcccggcgttcaccgagcattttcgcgtgttgcgctacgacacccgtggccatggcaaatccctggtgaccgaagggccgtacagcatcgagcaactgggccgagacgtgattgccctgctggatgcgctgggtatccagcgtgcgcatttttgcggactgtccatgggcgggttgatcggccaatggctgggcattcacgccggcgaacgcctgcaacgcctggtggtatgtaataccgccgccaagatcggcacgccggacacctggaacccacgcatcgaaatggtcctgcgcgatggcgcagccgcgatggtcgccctgcgtgatgcctcgattgcgcgctggttcacagcggattttgctgccgccaatccgcaccaggccaagcagatcaccgacatgctcgcggctacttcgcccaaggggtatgccgctaactgcggtgcggtgcgcgatgcagattttcgtgagcaattgtcgttgatcaaggtgccgaccctggtcattgccggcactgaagacgccgtgacgccgcccgccggaagccactttatccagagccatgtgcgcggcgccgaatacgccgagttctatgcggcgcacctgtccaatgtgcaagccggcgctgcattcagcgaccgggtgattaaattcctgctggcccgctgaggagctttttgtggacgagaaacaacgttacgccgacggcctgcaagtgcgccgcgaagtactgggcgatacccatgtcgatcgcagcctcaatgccctgaccgagttcaacagcgagttccaggaaatgatcacccgccacgcctggggtgatatctggacgcgccccggactgcctcggcatacccgcagcctgatcactattgcgatgctgatcggcatgaaccgcagtgaagaactgaaattgcacctgcgcgccgctgccagcaatggggtgacccgcgccgagatcaaggaagtgttgatgcagagtgcgatttactgcgggattccggcggcaaatgcaacctttcacctggctgagtcggtgtgggatgaattgggcgttgagtcccgagaaacctgagttgaaatacggtcaacctgtgggagggggcaagtcgaatcgtcgcaccgcgcctcccacatttctgatctctacaacctgcagagatcagcgtgaatcggcatcccatacccaattccatacgcctggcaggtgcacgggctcgcttacgaccttcaccgtacgtgccagcgccgcctgttgaagctgggtggtgtcggtgtagaaaggctcgacagcggtgttcaaaccattgatttgcgcgctgtccatcaggatctgcaagtactcctgcatatgtcgcgcggtgtagcggttgatatcgtggaaagtcaccaccacggggataacgccgtccaccgtcggtaattcgcccagggcaatgcgttcacgtaccagtgacaactgccggtacaaattggcccgtcggcgcgggctgccattgaaaccccagatcttgccgtcgttggcgctcaggtccgtcagcaacacctgcaggccatgccgctggtaggcggcgaaggtgcgcttgtcgtagttccagaagggcgggcgtaccagcaccggaggcgtgccggtgatgctggcaatatcggcggcaccttcggtcagggtgcgttccagttcggtatcattgagccagcgatggttagtatgaagcgccgttgccgtatggaatgccaggatgtggccggcggcatgttcgcgctccatggtcttgcgcccccgggagctgccgccggagcgggccgcctcggtctgcaggaagaacaccgccttgatacccggcagtaccgggttgtgcgccaggtcggctatcactgagcggctcggattgttgtagcccgaggcgctgggaccgtcatcgaaggtcagcaggaagcggatcggtgcctgggtttgcaagcgttgctgggtggccggcgtcagggcaacaggtgcgccgatgcagccgctcaggcacagggccagggccaacaatgcgcttgctatggcaagggatctcatgaggggcgcaggctcgataggggccgctgtcaaaggggatcagcagcggcaggcgcgcaccataccttaagtctggcgccggtttacagcagacttatcggatagctgacgatcaaccggttttcatcaaactcattgttgctgtagtcccggcgcatgctcgaattgcgccaacgtacattgaaattcttcagtgcgccgctctgcaccgtatagccgacttcactctcgcggccccattccttgccgtcgctgatggtgccggtgtgcacgttgctgccgctgatataacggttcatcagcgtcaggccgggtatgccgagagcggcgaagttgtagtcgtggcgcacttgccaggatttttcctcggcgttgtcgtaactcgagttataactgtcattggcgagggtgccgccactggtgccattgacgcgcatccaggcgctgttgccggtgagtgtttgcaggccgacgtagaaggtgttgccgccgtacctggcggagaacaggccggaccaggttttgttgtccaggctgcctgcgcgggcgctgccgtcgtccttgccgtagaagaacccgaggttggcgccgagggtccagttgccgacgggctggctgtggatcaggttgatgaattgctgactgtagatgtccttgagctgggcgttccatacgccgacctgggtgcgcttgtcgttgaacgcatattcggcaccctggaagttgaaacggtcggaagtaaatgcagctttaccgagcatcgacatgtcgctcatgctgccgtcatcacgcgggctgttggcgcggaactggccgccatacagggtcaggccgtcgatttccttcgaggtgatctgcccgccgcgcagggtctgcggcagggagcggccgtcgtccgaacgcaggatcggcagcaccggcatccattcgcctaccttcagctccgtcttggaaaaccgcgccttgaaggccgcgcccaggcgtccgaattcgtccgccggccggccatcatggtccagcggcagcaactgggtgccgcccgtgccacgtccgccatcgagcttgagcgagtacaagccgagcaaatccacaccaaaacctacggtgccttgggtaaagccggacttggcgtcgaggatgaaactctgcgtccactcctgcgcaccgccctgggccttggtcgggttggtgtaattgcggttgaagaagaaattacgcaggttgagattggcgctggcgtcttcgagaaagccgtgttcttcggcgatagcgggaagggcaaggctggcgacagcggtcgccagcaacagctggcgcggttggaaagtgctcatggcgttggacctgttgttattggggttatgcaggtggcggccatggtgcgcggcggtgtgggggcgattcaaccggggcagggtgggttgtgggcgatgatcgaacgcaagttggcggggtaataatccaggcataaaaaaaccgcttccggtgagggaagcggtttttttacacctgcactatcagaacagcttcaagggcggtgcttcttctttcaatggctcgttctgcgcggtctgttcgttccagccaccgccgagggccttgtacaggttcacctcgctggtcagctgcgcaaggcggtcggtgatcagcgattgctgggcactgaacagttggcgctgggcgtcgaggaaggtcaggttgctgtcgacaccaatgcggtagcgacgctcggccaggcggtagtagtcctggttagcctcgacgaagccacgttgggcgtccagttgctgcttgtaggtcgcccgtgcggcaaggccgtcggagacttcctggaagccggtctggatcgctttctcgtagttggccacgttgatctctttctggatcttcgagtagtccaggcttgcgcgcaggctaccggcattgaagatcgggatgttgatctgcggggcgaacgcccaggtgcccgagccgcctttgaacaggccgcccagggtagggctggcggtgccggcgctggcggtcaggctgatgctcgggaaaaacgcagcacgggccgcgccgatattggcgttggccgccttgaggttgtactcggcctgcacaatgtcgggacgacgttgcagcaggtccgatggcaacccggcagggacttcgctgagcaggttatccgacagcggcttgctggcgatattcgccggcaggccggtgcccagcaacagggtcaggttgttttcgtcctgggccacctggcgggtataccgggccagttggacccgggcgttttccaccgaggtgcgtgcctggctgaggtccagcgccgaggccacgccgacttcgttgctgcgcgaggtgagcttgaagctctgctcgaaagcaccgagggtgtcctgggtcagcttgagcagttccttgtcggcctgccaggtcaggtaggcattcgccacgctggccaccaggctgatctgggtgctgcgccgcgcctcttcagtggcgaagtacttttgcagcgcttcttcactcaggctgcgtacgcgaccgaacaggtccagctcgtaagagctgatcccgaggccggcagagtattggctggtgatgcctgcttcgccggtctgcgacagcttggccggggtgcgctggcggctgccgctgccggtggccgacacggccgggaacaggtcggcacgctggatctggtactgcgccgcataggcgtcgatgttcaaggccgcgacacgcaggtcacggttgttcaccaacgcggtctggatcagctgctgcagggcagggtcatggaaaaactgcttccagccttgctcggcagcggcctggcccggcgcctgggccgacgaatacgccggcccctgcgggaactgcgcggccaccggcgcatcgggacgctgatagtcaggtatcagcgagcagccactgagcacgaatgccgtgacggctagggaaagtagcgacttgctcattggccagcctctttaggagtttcagtagtgtctttctttttgcgttcgccagccgaggacacggttgcatagaacagtggcacccagaagatcgccagcacggtggcggtgatcataccgccgattacgccggtaccgattgcgtgttggctacctgagcctgcgccactggaaatcgccagcggcagtacgccgagcacgaacgccatggacgtcatgatgatcgggcgcagacgcatccgcgaagcttcgatcgccgcctcgacgatgcctttgccttgctcatgcagctccttggcgaattccacgatcaggatggcgtttttcgccgccaggcccaccgtcaccaacaagcccacttggaagaacacgtcgttggacaagccacgcatactggtagcgatcagcgcaccgatcacacccagtggcaccaccagaatcactgcaatcgggatcgaccagctttcgtacagtgccgccaggcacaggaatacaaccagcagcgacagtgcgtacagcgcaggtgcctgggagccggacaggcgttcttcatacgacaggcctgtccaggagtagccgatgccggccggcagttccttggcaatgcgttcgacttccgccatcgcgtcaccggtactgtagcccggcgccggggtaccgaggatttccatcgccgctacaccgttgtatcgcgagagcttcggcgaaccgaagatccacttgcccgacgaaatggccgacaacggcaccatcttcccggagtcgctgcgcacgtaccatttgtccaggtcttccggcgccatacggctggcagcgtcaccttgcacatacaccttcttcacacgaccacggtcgatgaagtcgttgatgtagctgccacccagggcaatggccagggtctgctggatatcggcgaggctgatgccctgggcgctggctttctcgtcgtcgacggtcagctcgtactgtggttcatcgttcacgccgtttggacgtacacctgccagtaccttgctttgcgccgccgcaccgaggaactggttacgtgcagccatcagcttgtcgtggccgacgccaccctggtcttgcaggaacacgtcgaaaccggtggcgttacccaattcaagaaccgaaggtggcacgatggcgaataccattgcgtccttgaaggctccgaagaagtaaccctgggcccgcttggcgacttcgaataccgattgggtcgagtcacgctcatcccacggcttgagcatcacaaacgcgaggcccgagctctggccacggccggcgaagttgaagccgtttacggtaaacaccgagttcactgacttgccttcgcctggctcgccttccttgtcatgcagcaggaaggcgcgcatgtcatcgatgactttttgcgtacgttcagccgaagagccgaccggtgtctgcacctgggcaaagatcacgccctggtcttcctcaggcaggaacgcgctcgggatacgggtgaacatccagatcatgccggccaggatcagcacatacaccaggaatgccgggatcttgtgcttgatcatgccgcccacgccgcgctcgtacttgagtacgccgctgtcgaaggtgcggttgaaccagccgaagaagccgcgcttgggttggccgtgcttttccggatcgatcggcttgagcatggtggcgcacaaggctggggtgaagatcagggcaaccatgaccgacaacgccatcgccgaaacaatggtgatggagaactggcggtagatcaccccggtggaaccaccgaagaacgccatcggcagcagtaccgccgacagtaccaaagcaatacccaccagggcgccctggatctggcccatggacttgatcgtcgcttctttgggcgacagatgttcctcggccattacccgttcgacgttttccaccaccacgatggcatcgtccaccagcaagccgatggccaggatcatgccgaacatggtcagggtgttgatggtgaagccgcacgcggccaggatcccgaaggtgcccagcaataccaccggtacggtcatggtggtaatgatggtggcgcggaagttctgcaggaacaggaacatcaccaggaacaccagcacgatcgcttcgaccagggtgtgaaccacaccggagatcgattcggtcactaccggggtggtgtcatacggcaccaccgccttcatgcccggcgggaagaacggctccagggacttcactgtttcgcggatggccttgccggtgtccaatgcgttggcacctgccgccagcttgatggccatacccgaggccggcttgccgttgaactgcgcactgatgctgtagttctggccgcccagctcgatacgcgcgacgtcacccaggcgaacctgggagccgtcggtgttgaccttcatcaggatcttggcgaactcttcagcgctttgcaggcgcgtcttgccgataatggtagcgttcagctgggtaccgggcagggcaggcaggccgcccaattggccggtggccacctgcacgttctgcgccttgatggcgttgctgacatccaccggggtgagctggtagttgttcagcttggccgggtcgagccagatacgcatggcgtactgcgaaccgaagacctggaagtcacctacacccgaggtacgggaaatcgggtcctggatgttggacacgatgtagttggacaagtcgtctttggtcatgctgccgtcttccgacaccagaccgattaccatcaggaagttcttcaccgacttggtcacgcggataccctgttgctgcacttcttgcggcagcagcggggtggccaggttcagcttgttctgcacctggacctgggcgatatccgggttggtaccctggttgaacgtcgcggtgatggtcatgctgccgtcggagttactgtccgaggcgacataacgcaggttgtcgataccgttgagctgttgctcgatgacctgaaccacggtgtcttgcacggtttgtgcggacgcgcctgggtaggtcacctggatatcaatggccgttggcgcaatggccgggtattggttgatgggcaacttcaggatcgacagtgccccgaccagcatgatcaccagggctattacccaggcaaaaatgggacggtcgataaaaaatttcgacatggattactccccttgaccagcagcggcagcaggcgctgcagcagtaccggcgggtttggcgttgtcggcgtccttgaccttgacttcgatacccggcttgatgaattgcaggccctcggtgatcacgcggtcaccggcgtccaggcctttttccaccagccagtaggcaccggcagtgcggttggcaaccagttcgcgttgctcgaccttgttgtccttgttcacgatcagcgccgtcggaatgcccctgaggtcacgggtcacgccttgttgcggagcgagaatggccttgctgttcacacccgcttgcagctgggcgtgcacgaacatgcccggcagcagcacatggtcagggttggggaacacggcacgcagggtcacggaaccggtggtctggtcgaccgacacttcggagaattcgagcttgccgtcctgggcgtaaggcgtgccgtcttccagggtcagcttgaccttggccgcgttgtcgccggctttctccagttggccactggcaaggtcgcgacgcagcttcagcatttcagccgaggactgggtaacgtcgacgtagatcgggtccagttgctggatcacggccatggcatcggcctggccattgctgaccagtgcgccttcggtgaccgaagagcggccgatacgcccggagatcggtgcgaacaccttggtgtagcgcacattgatctgggcgctctgcaggtcggcttcggcggtcatgcggtcggcgacggcggtgtcgtattcctggcggctgacggcctgttcatcgaccagttgcttgtagcggtcggtgatcgacttggtctgggtcagcttggcctgggcgctcttgagtgtcgcctcatagaccgacgggtcgatctggtacaactgctggccttccttcacatccgcgccttccttgaacaagcgcttgagaatgatgccgttaacctgaggccggacttccgcgatgcgataggccgtggtgcggcctggcaactcggtggtcagggtaaaggcttgcggttgaatggtgaccacgccgacctgaggggtttgagcgggcggtgccgcttcttcctttttacatccgctgagcagcgatgccagggcgacggcagtgaccagagcggtaacagctggcttaagttgcatgaagatcctcgggtcaggcgcgcagagtgcgcacaagaagtgtggaaaggtaaaaaacaggctgtgagtggataagtagcttgctacgcaatatacttacgttcatggttgtttgtaaactcttgacaggccgtgcgcaatgttgacaaagcagcgccccaagcctcgattctagtacgttcggcgcccctgacggcgtcgtcccacaattattcagatgatggtcaagcaccatccacagtgtcccgattgaggttttactgccatggttcgtcgcaccaaagaggaagctcaggaaacgcgcagccagattctccaagccgctgagcaagccttctatgagcgtggcgtggcgcgcaccaccctggcggacatcgccgcgctggcgggggtgacgcgcggtgccatctactggcatttcagcaataagtccgatttgctccaggcattgctcgacacgctgcacgagcccctggacgaattggcccgcgccagtgaaagcgaggacgaagtcgacccgctgggctgtatgcgcaagttgttgattcatctctaccatgaagtggccctggacccgaaaacccggcgcatcaacgaaatcctgtttcataagtgcgagttcaccgatgaaatgtgtgacatgcgccgccaacgccagacccacagtcttgaatgcaacctgcgtatcggcttgacgttgcgtaacgcggtccatcgcgggcaactgccggaaacgctcgataccacccgcggggccatatgcatccatgcgtttatccacggtctgatcggacagtggctgttggtgcctgacagttttcaactgcatcaagacgccgagcgctgggctgacatagggctggacatgctgcgcctgagccccagcctgcgcaattgagacaaaatgcgtaattgcatccagttgtgtcaacagtaaagaccagagacagtcaatcgtccctttgcctgattggcggggtgactttatatacgggctggcctgcggttgataggtagccggctaagtattttgtagcgatattgttgcggttctgtgaagcaatgtttccaagtggctacatacagtcaaaatgtgggagggggcttgctcccgatagcggtgtgtcagtcaatgatgtgttgactgagccaccgctatcgggagcaagccccctcccagtttgtttttctgtttcagtcagttagatcggcagcgtcgggtaatcgatataacccaccgggcccttgccatagaaggtttctgggtgcggctcattcagcgctgcatccgccttcaagcgcgccggcaggtctgggttggcaatgaagggaatgccgaaagccacggcatcggctttaccttcggccagccaggcgttggcgctgtctttggtgaagcgttcgttggcgatgtagggaccgccgaaggcttttttcagttgtggcccgaggctgtccgcgccttctttttcacgggagcagatgaaggcgatgccacgtttgcccagttcgctggcgacgtaggtgaaggtttcggccaggttggcgtcgcccatgtcgtgcgcatcggcacgcggtgccaggtgcacgcccacgcggccggcgccccagacttcgatggcggcgtcggtcacttccagcagcaggcgcgcacggttctccagggagccaccgtagctgtcggtgcgctggttggtgctgctttgcaggaactggtcgagcaggtagccgttggcgccgtggatttccacgccgtcaaaccctgcagccttggcgttctcggcacctacgcggtaagcgtcgacgatgtcggcgatttcagcggtttccagggcgcgtggggtcgggtagtcggccaatggacgaaccaggctgacgtgacctttggcctggatcgcgctgggggccaccggggtttcgccgtccaggtaggactcgtgggaaatgcggcccacatgccacagttgcaggaaaatcttgccgcccgcaccgtgtacggccttggtgatgttggcccagccgcgcacctggtcgttggaccagatgcctggggtgtccgggtagcccacgcccatgggcgtcacggaggtggcttcgctgaggatcagcccggcggaggcacgctgcacgtagtactcggccatcagcgcgttgggcacgcgaccggcgtcggcgcggcagcgggtcagcggcgccatgatgatgcggttcgacagttccaggtcgcccagtgtgatcggatcgaaaatagtcgtcatgggataacacccttctctttaagtggattgatcagttggtcgcaggggccaggtcggcatcgccgctctgacggaaagtgatcagggtcaccagcagggccaggatcgccagtgctgcggcggccagcggcacgctggtcaggccgaaaccgtgggcaatcacgctgccaccgacccaggcgccaagggcgttgccgatattgaaagcgccgatgttcaaggtggacaccaggttcggtgctgctttgccgaaggtcactacattgatttgcagcgccggtacggctgcaaacgaagcggtggcccacaggaacagggtgatttcggtggggatcagcgcgacgctggtccaggacaggacagttgagaccaccgccatgctgatgaacacgccgatcagggtggccgccaggcgcttgtccgccagcttgccgccgatgatgttgcctacggtcaggcccaggccgatcagcagcagggtccaggtcacgcccttgggtgacacgccggtgacatcgccgagtagcggtgcgacgtaggtaaagagggtgaacatggaggcggcgaacaatgccgtcatgctcagcgacaaccagatgccggcacccttgagggctgccagttcggcacgcatgtcgagtttttcttcgtcacgcttggccggcaggaagcggatcaggccgatcaaggcgatcacgccaatcacggtcaccgcccaaaaggtcgaacgccagcccgcttgctggcccagggcggtgcccagtggtacgccgagcacgttggccagggtcaggccggtgaacatcaaggccacggccgaagcgcgcttgttggctggtaccaggttggccgcgaccactgagccaatcccaaagaaggcgccgtggcacagcgccgtgatgacgcgagcaaacatcagcacgttgtagtcactggccgaggcgcagagcaggttgccgataatgaaaatgcccatcaacgctaccagcgccgccttgcgtggcagcttggcggtggccagtgccatgaacggcgcaccgatggccacgcccagggcgtagccagtaaccagccagccggcgccgggaatcgacacgcccaggtccgccgccacatcaggcagcagccccatgatgacgaattcggtggtgccgatggcgaaggcgctgagggccagtatgagtagcgagaggggcatctacgtttcctttattacagcggtgcgctcatatcagcgctgagttcagtggtgagcgccacgagaaaggcttggatcactgcctcgttgcgtttgaaaaagtgccattgcccggccttctgactgctgatcaacccggctcgttgcaaagtggccaggtgggccgacacggtcgactgggacaagccgcagcgctggtcgatctgcccggcgcagatgccgtattcatggttgtgcagttgctcggggaattgcaccttcgggtctttcagccaggtgaggatgtctcgtcgtactgggtgcgccagggcttttattatttcgtcgaggtcaatggacatggcagttgctcggtgtcgtaaagcgttatatcgcgatgaggcgaactttaaatcggtctatcccgatataccaatatgaatttgatctgaggtcaggcttaatcggtatatcgggttataacgatatgttaaaggcagtgttagactgcgcgccatgaattatctcgcacatctgcacctgggcggccaacttcctgcgcaactgctgggcagcctctatggcgacttcgtcaaaggtcgcttgcagggccagttcagcccgcaaatcgaagcggcgatccagctgcatcgctccattgaccgttttaccgatagccatgcgctggtgagcgaggcgttgtcgcgtttcagcctgacccgcaggcgctatgccgggatcgtcctcgatgtgtttttcgaccattgcctggcgcgggattgggcactgtatgccgaccagcccctggagcgttttacctcgcaggtgtatcgcgtgctggcggccgaacccgctttgccggggcggctggcgcagattgcgccctacatggcggcggatgattggctgggctcgtatcgcgagtttgcggtgatggagcaggtgctgcgtgggatttcgcggcggctgactgacccagacgcgttggggtttgcgatgcaggagttgcgggtgttgtatgaaccactgagtagagacttcagtgagttctacccagagttacaggcattcgcacaaacccagcaggctacacagaattaaatgtgggagggggcttgctccctcccacatttaaccgtgcccgctttaggccgcaaacgcaggccgagtatttactggctcaacctccggcaccggcccaaacaatgcctgctgcaccgcctgctgcgcctggaacgccaacgccgcacgctcttgcccggcgcaggcaatgggcttgagcatatggatttccacattgccttggtcattggaaaacaggcgcatcaggtgcgagagcaaatcatcatcgccaataaacggtgccagcgggtcgacctggccgtcgcgcaaataacggatcgctaccggttgcagcgacacatccgcctcaatcgcgctggccagtaaacgcccgtggaaggtacgcaggctgcgcccgtcggtggtggtgccttcgggaaacatcagcaacgggtgctgttgctccagatgacgggtcatctgcttgcggatcaactggctgtcgcccgcgccgcgacggataaacaggctgccagccttggccgccaaccagcctgccaccggccaggtgcgcacttcggccttggacaggaacgacatcggcgtgaccatgcccagcagcgggatatccgtccaggacacgtgattgctcacccacagcatcggctgttgcggcaccttaccgtgcaccgtcacgcgaaagggcagggcgttgctcaggcgcgccataaagaaccgcgaccaacgctggcgtcgcaccatcgagttggcgacacccaagcgctcgaacaggccaaacacactggccatgctcaaacccagcgccaccaccagcagcacccgggcgatgcgcccgtacacacgcaggcggctcatcacatggccgccttgaagtgccgcgcataacgcgggcacaactcatcgcgcttgagcaggatgaacacgtcggcgacctggaagtcttcatcccagcacggctcgccgcagatctttgcgcccaggcgcatataggccttgagcagtggtggcatctcggcgatgacgttggacggcaggtccagggccggcagcggttttttcggttcggcgcgcaggtgttcgttgcacaggtagcgttcgcgcaggcgctgcatgatcgcgtgcgcctggataccgccatcgtgcatcgggatgctcgcgcagcccatcaggtagctgtagccaccctggttgagcacctcggccaactcgccccacaataccgcgatggtaccgccgttgcggtaggccgggtcgacgcaggtgcggccgatttcgaggatcgggccctgcaagtgcagcaggccatgcaggctgaattcttcttcgctgtagaaccggcccagggtgctcgcggcctggtggtcgagcagacgggtggtggcgacgagtcgaccgctgttcaaatcccgcacgccgatgtggctgcagtgaacatcatagtcatccatgtccaggcccagttccgcgcctttcagcttggcgttgaactcgccgctgaacacgttgaaccgcagggcctgggcttcctgcaaagcctgtgcgcccgccaggcgttcggcttgcagacggcgttcattgcctttgtcgctgatgcgggcgatctgagtcatagcgagtctccgagtgccggccaggttgtacggccagtcgactttgttgtccaaagtcaggctatgtagcctcggtgtcatctccatgaaattacggtgacggttggatgacagaccctgtgtagcaaatctgtcattggcctgcgctaggctcgcgggcttgaatgcccccccttgagtttgcgtccatggtccgaggcctgttgtgcgttgccctgctgtttgtcaccgttaccgcccgcgccgaaacctggcctgaaaaggattgggccatgggcgcaccactcaatggccccgctgtcgatgcactggacgcctacgctttcccgccccgtgacgacaccagccgcgaaggcattcgtaccgatgcgctgctggtcattcgtgacggcgaaatcatctacgaacgctacgccgcgccatccaccgccagcacgccgcacctgacctggtcggtgagcaaaagcctgatggccacggtgcttggagtcgcctacggcgaaaaccgcttcaagttgagcgaccccgttgcgcgtttctacccgccgatgaagcagcatcccaaggtgaccatggccgacctgctgcactgggcctcgggcctggactggcaggaagactatgaatacgcgccgctgaaatcctcggtggtggcgatgctctacacccgaggtcgtggcgatatggccgagtttgccgccagtaccgacgctgctgctgccccgggccaggcgtttcgttattccagtggcgacagcaacatcttgtctgcggccctcaagggcatgctcggccacaaggcgtatatgagctatccgtgggatgcgttgttcaagccgttgggcattcgcaatgcgacctgggaaaccgatgctgatgaaaccttcgtcgcctcgtcctatgcctacctcaccgcccgcgatctggcgcgtgtcggcctgctgatggcgcggggtggacgttggggtgagcaacagttattgcctgaagaatgggtcgccttcaatcgccagccgttcgccaaatacaaaagcggccaggatgaagcggttcccggcggccaatggtggctcaacacgggtgcgtccagaccgtggcccgatgcccccgccaataccttcgccgcattgggccactggggccaagcgttgtttgtgatacctgacgaacacctggtgatcgtgcgctacggcgatgaccgcgacggcagctaccgtcataacgaactgctcaagcgcgtgctggcggcggtgcggtcatgatccgtcgtcggccgtttaccagtctgtttctgctgctgttgctcgccctgctgggctgggtgtggcatgagcgcgtcaacctgcaagccttccccgacatcatcgcggcatacaccgccaaggagtattgctcgtgccggtatgtggaaaacaacccggcgcagtattgccgtgggtatgtgaagcagtacgtgccgaccagtgcgttgatcgacacgcctgagcgcagtgaagtgacggcgagtgggttggggcgtacgcatacggcaaggtggttgggggagcggcaggggtgtcgcttggtgccgtgaggtagctgatcaggcgggtttgccagaaacgctgcatgatcggcgtatagctttgtgtcgaatattgttctccgcccttgtttgaatgtttcattcgctaagcagatacagccccagcaagcaggaaagtaatatgatttctgaaataaaaaaaccgaacagcttgagtttaaggtgttgagggaggttttttagttcctgcggttcaagtgtgccgcgacttacaaagaatcgactgcatgtaattattattgatgtggctactataaatattatggttgcagtccagctggtagcgttgagtctggctctgattgtaatggcagagctatgcctgaacccaagaatgattgagctgccatgtttctttcccatccataaacaagctaaagcccagatcggcactgctatgatggtcagcactgccacgcccaagtgaagagggggcatggcggtccatttaacaagaaatattagccagcaaaacaaaaacatccaagtgaagatatataaagatttattgaggatagataagcgccttttgagtgctttggggaatttatctatatcttcaatgcaagctccgccgtcaggtagaaaaaggcgtggcgtgcttatgacgctgaaaatcctacctaaaacaaccagcctccccaaaggaccaccgtgaattaagcctgatagcatgatcacggcaggacaattttttagacaattcagcattagctccatcttggtataggcaatatgcagcaacatgcctagggcaattactgtgccgccaaacccgatcaagctgacacataggaatattgtatccgctgtactaacgctcacgttgttgcctcataaatgacttctcccatttgtttcgcctttgtaaaggtgatctcggtagcaaagactccaaggtttaaatgaatgaaacgcaggtttattagcagaagctgacctgtcagggaccttggtaagtccggttgtattacttgagcttcaacagaatgactacaagtatcagccacgctaaagaggcaagcatcagtgccgtatcggcaatcagatgccttttcagatgaggcgggaaatgttcaagatcggcagggtttatatctcccatacggatatatgcctttgaccacaaaaccactccggcaattttcgaaatttccaatagggaccaaatcaagccccgcctccctaagctcggcccccaaagataaatataacggctgttctttaaggcctcccttatggcgtctaggtggtagcggctcaggtaaagactgtatccagtaccggcaattgcgaggagaccaggggtaccaataaaaatgatcgcaatccagggggcccaggtgtcgatgctggtcatggctgagtaacctcgtagattttctcccccatagcttcgccagcgatcccgccacccggcgcaccgaccttgtccaaatggtgcactaagctgcgactggatatgccgagagccgatttcaacttgggaactattaccttactcaaactctatcaacacagatatggccgccagccaaataacccccaccactattaatcccgttacgactttcagtcgacgtttaaggtaaggagggaagttttcaagatcaatggggtcaagctcacccatgcgaagtgatgcccttggcatcaggatcatcccagcgatttttgatatttccaaaagggaccaaatcaaaccccgcttacccaggctcgacccccacagataaatataacgactgttccttaaagcctccttcatggcgcccagatgatggtggcttaggtacagactgtatgtaacagccacaattgcaatcagaattggcccggccagaagccagataagtagccaggacttccaaaattcctcgatggtcatggcagagttttctcatacaatttttcacccaatgtttcgccaccgctaccgccgtaagtggtgcctgcccaagtgccagttcctactagggcggcgacacagacaacgccccctatacctgtagagacgccaagcgccacacaaatcgaactactggcagatctggccatcagtccgcccagcgtaccgcctgcggtggcaccggcgaattttcctccctcagtaaacttaaccttctcacacgcagccccagaatccccgttacacacctgctcaatagctagcagcgaggagataccgccaagaccaataccgatgtaaccacctgccttcatatacttcgtggcacgactgaccgcctccacatgagcggcataccccggaatctgccccggtccacccgctttgtcccagtgatgcaccaggctgcggctggaaattcccagggccgttttcaacttcgggtgatcgcccaaagttgtctggccacgcaagcgcgtggagttgagtaaatgggcatccagctggttcatcagccgatgacgatcggcaaagaactgcgtcgatttaaggtggccgtgctggcgatagttttcttgatgcaagtgctcgatggcttgaagggcgtcgcgcaggctggtcaggtgtttttccatcaccaccgcgctgacgccgagccaggttgaggtatggcctatgaagctggcgatttcggcaccgtgtcgatacagaaagtcggcctcgtccggcgtaagggaatccagggaggcatcgacttgttgagcggcctgcatcaactgcgcttcctgataagtgcaggaggtgttgttcggatcgctgagcacgatcattgagccggctttgacgttgccggtattgggattcagtgattgaaacttacgcatcacagccggatcaatcgtcgaaaaaagtgtggtctccaatgcttcgcgggacatgctcttgggcacgatgtagaagcctggttcctgacccagcgccccgttgaatgccgttggcactgtacgaccggaaggcgtgaaagctgattgagacggcgtttctgggttgccgtttacagctgcctcattcggttgagcaacccgctgactcgctggcggttctgcttctcgcttttcgtaggtggcctttaacaccgaaggaatcaaccgggctccacaggggcaactgctcacgctatccagcgtgccagcaacacgttttccattgcgcctcatattggaaatgccgcctaggatccggaagtttccggcatgatttccgcaagtgacccgagcaccttccagagcacggtgaaggccatgtaacttgaatgttggatcaccctcgagaattcgtccgccgcacgtcgtttggtcccctaaaacaacatagtgccctttgctcattttcttgccccttatcatccaagtcgttgttgccacaccttcctcaatcgaggtaaacgagaacgaggaagtcagcgacaagccaaactttggagagggatttgctgagggtaaagtcggacgattccgtgagtttcgtcgtataaatctgaagggattgcggcgcccgatgccgtgcaccgggcgcgtattaattactgcgcaggtggagtgcctggctgcatcgccagcagcaggtcgtcgatgatagctttgcccatttcgcccaagtaatgcgaggcgaacgcaaacctctcggccctggggtccatggcagcttcaagggagagcatttttgcgtaatagagcacgtgggatgcgtgttcgagggcttctacaagcggaaccccggcgttgacgcggaatagtttcagatggcttttgttttctccgcagtctgcgaaggtggcggcgccgatggtttcggctgagggtatttcgtacggcataagcttgctcctttggtacaaccaaaaagagctgccattcacgattccaagcatgagggtggcagctgtacgcaggttggaatccgagaagaagcaactcggcaggcacaaggcctcccacgcacagccgccataaagcacaaacagcgggcacaaaaaagcgccgactgattgcatgacgacgctgtagcgtcttctttctcgggattccacgcccggtcactgatgagcagcgacggtggggagattaacgctatgcaggcgccctcgcaaccggtggcaaatggctgttgtgtttagcgagcatgctgatggcagcggcgggtcagttagaaatgttttggctggcactcagtcatcgggggcaagccccctcccacattatgatctccagagattttaagaaaatggttggcctcaggttccacagggtggaaccacctttggttgtcctcacgcccacatcgcggttagctggcggtgtgtcgccaacaagaacgggaacacccgcctgtgaggagaatcaccatgcgcccacaccagcacatcctggattggctcagcgacgtcgccagcgacttgcacgctgtgcgtcacgatatccatgcccatcctgagcttggctttgaagagaaccgtacctcggcactggtcgcgcaatccttgcgggaatgggggtatgaggtgcataccggcatcggcaagaccggtgtggtcggcgtgctgcgtaacggcagcagctcgcgcacgctgggcattcgcgccgatatggacgccttgcccatcatcgaaaacaccggcgcggcctacaccagccagcacgccggttgcatgcacgcctgcgggcatgacggtcataccaccatgttgctcggcgctgcccgctacctggcggcgacgcggcagttcgacggcacgctgaatctgattttccaacctgccgaagaaggccagggcggtgccgaggcgatgctggcggagggtttgctggagcgctttccctgtgatgggttgttcggcatgcacaatatgccgggcttgccggcggggcatttgggattaagagttggcccgatgatggcgtcccaggacttgctcaccgttaccctcgaaggcgtcggtggccatggctccatgccgcacctcacagtcgatccattggtggcggccgccagcatggtcatggccttgcagacggtggtggctcgcaatatcgacacccaggaagccgccgtggtcacggtaggcgccttgcaggccggccaggctgccaacgtgattccccagcaagcgttattgcgcctgagcctgcgcgcactcaaccccaaggtacgtgaacaaatgctggaacgggtcaacgcaatcatccagacccaggccgccagcttcggctgcacggtgcagatcgaacaccgcccggcctatccggtgctggtcaaccacgccgaagaaaccgagtttgcccgccaggtcggcgtagccttgctcggcgccgacgccgtggacggcaacacccgcacgctgatgggcagcgaagacttcgcctggatgctgcaacgctgccccggcagctacctgtttatcggcaatggcgtatcgcggccgatggtgcataaccccgcctatgacttcaacgacgacatcctgctgaccggcgccgcctattggggcgcgctggccgagagctggttgaaaccagctggatgatccgaatacccgtaggagcgagcttgctcgcgagaaaccaacagacgactcgggctacctgaaagcgctgcgtcatcgttgacgattttcgcgagcaagctcgctcctacagcaacacctttttttctgccgctggaccctttcccttatcggttgaatggagtgttcctcatgcagacttcaaaacctggcgtctcccgcacccgtcaagtggtggcggccgtgatcggcaacgcgctggagtggtacgactttatcgtctatggctttctggccagcatcatcgcccggcaattcttcccctccgaggatgaatacgcttcgctgctgatggccttggccacctttggcgtgggctttttcatgcgcccagtgggcggcatcctgttgggtatctactccgaccgcaaaggccgcaaggcggcgatgcagttgattatccggctgatgacggtgtccatcgcaatgatcgcctttgcgccaaactatgccgccatcggcatgggcgcgccgctgctgatcgtggtggcgcgcatgctccagggctttgccaccggcggggaatacgccagtgccaccgcgttcctggtagaaagtgcgccggcccatcgcaagggcttgtacggctcgtggcagctggtggggcagtgcctggcggtgtttgggggagcagcgatggtggcgctggtgacgcacttcttttcccccgaaaccctcgacctgtggggctggcgcctgccgttcgtactgggcttgctgatcggcccggtggggttgtggattcgtcggcacatggaagacccggaagagttcattgaggcgcgcagaaacgccaccggcccggcgccgagcctgatgaatgtgttgcgtgatcatcgccgcagcatcctggtgtccctgggcctggcctgtggggcgacggtgtcgttctatgtggtgctggtgaacatgccgaccttcgcccacaagaacctcggcctgccgttggacgaggtgctgatggtgcagatgtttgcggtggcgctgatgaccgtggtgattccgttgtccggcctgctttcggatcgcctggggcggcggccggtgctgatggcgttcaccctggccttctttgtgatggtctacccgctctatgtgtgggtggctgctgcgccgtccatcgagcgtttgctggtgatgcaggtgatgctgtgcaccgccattggcgggttcttcggcccggcaccgacggcattggccgaacagtttcccatcgaggtgcgctccaccggcgtgtcggtggcctataacgtagcggtgatggtgttcggtggttttgcaccgttgatcgtgacctggctgagtaaggtgctgggcacaccggtggcgccgtcgttctatgtgttgttcgcttgcgtgctgacgctgttgggcacttactgcatgcaggaggcaccgcgggcgaaaaaaccgctgccgttttcaagcgaggtgaagccttgagtattgttgattgggatgccacgcaactgtcgcgagcgatccatgggcggcaggtgtcgtgtgaagaggtgatgcaggcgtacctggcgcagatccagcgctttaaccccagggtgaatgcactggtgtcgttgcgcgacagcgatgccgtgctggccgaggcgagagcctgtgatcgtgagctggaccacggccagtcccgcggctggatgcacggcatgccccaggcgatcaaggacctggcggcgacccaaggcttgcgcaccaccctgggctcaccgttgtttgccgagcatgtgccgagtgaagacgccatcagcgtggcgcgggtgcgggccagtggcgcgatcatcatcggcaagaccaacgtgccggagttcggcctgggctcccatacctacaacacgctgttcggtaccaccggcaatgcttatgacccgcgcctgtcggccggcggcagcagcggcggggcggcggtggccctggcgctgcgcatgctgccggtggccgatggcagcgacatgatgggctcgctgcgcaacccggcggcgttcaacaatgtgttcggcttgcgcccatctcaggggcgtgtgccccacgggccgatgccggaactgttcgtgcagcagttgggtaccgaaggcccgatgggccgcagcgtgacggatgtggcgcggttgctgagcatccaggccggttacgacccacgggcgccgttgtcatcccaggatgatcccgcgatgctgggccagccgctgcagcgcgacttcaaaggcgcacgcctgggctggctgggggactacaacggttatctgccgatggaagacggcgtgatgagcctgtgcgaaaccgccctgggtgacttcgccgagcttggctgcgaagtagaaagctgccagccggacttttcaatggctcgactgtggcgctgctggctggtacaccgccattggctggtgcacggcaacctcggcgcggcctatgccaacccgaaaaaacgtgcactgctcaagcctgaagcgcaatgggaagtggagggcggcctcggcttgagcgcccagcaggtgtaccaggcgtcggtggatcgtagcgagtggtatagagccctgaccaagttgttcgagcgttacgatttcctgctgctgcctaccgctcaactgttccctttcgatgcacaacaagcgtggccgtgccatgtggccgggcgcgaaatggacacctatcaccgctggatggaagtggtgatcggcccaaccctggccggcttgccgagcatgagcatccccgtgggcttcaacccccggggcctgcccatgggcctgcaaatcatcggcccggcccaggcggaccgcgccgtgctgcaattggcctatgcccatgaacagctgacccaatgggtacgacgccggccgccggaatgtcttgcagcgaccggctgagccgcgaccgggcctgcatcttgctgtgaaaatgatcatccaccggcaacagggagatcgaacatggacacaggcaccgtacgctcggttgagcgcgcactggcaatcgtcgagttgctgggtgagcaccaggccctggggctggaggaactgcactacctcacgcgcctgcccaaggccacggtgtcgcgcatgttgctgaccttgcaggaacagggctgggtctatcgcggcctgagcgatcggcgctaccgcctgcgtgcacgacgtttgtttggcgatacccagcaacgcttcaggcgccaggtggtggaaagcgcggcgccgtggttggtggagctgagcgaacgcaccggcttggtggtggacttgtcctgtttcgacggcgagcgcctggaagtcatggagagcgcgattcccagtgtgttgcgcaagctgtacccgaacaactgccagatcgtcggccagtacgccagcctgttccactcggcgatgggcaaggcgtgcctgacgcaactgccccttgatgaagtgcaacgcctggcgggccgcgaccgggtggccgccgatgagcaataccatgcgtgcgagcacacccagcaccaggggttcggccagcgtaccgagggctattgggaatacccggtgcgtctgccgttcctgatccgggcggtggcgttgccggtgcgcgcccatggccggttggtgggcagcatggccttgcattggccgatgcatcaggcgccggtggagcgggtgttgaacctgcatatggccagccttgaagaaacgatctgcgaagtccagcgggcattggcctgaacagtcgccgccggacccatgtgggagggggcttgctcccgatagcagggtgtcagccactggatgagttgctgatccaccgccttcgggagcaagccccccacattggatttgcgccgttcgtgagattgcgcttaatgttcgcccaggttttttgccccatgagtctttatgttcaatgtcaaacccctggtcttcgccctgctgacctgtgccagcgtgcctgcccacgccgactggtacctggataacgaatcctcgcgcctgtctttcgtcaccaccaaaaacaccgagattgccgaggtgcatcgcttcctggtgttgcatggcaaggtcgacgccaagggtgcggcgcagttgcaagtggagatggagtcgatcaacagtggcatcccactgcgcgacgagcgcatgcgcaaagagctgttccagatcaagaccttccccgaagcgcagatcagcgcgcagatcaatctgcaaccgatcaacgacctggcgcccggcgcgcagttggaattgcgcctgccgctgagcgttaccctgcatggcaagacccagacctacagcgccgaattgctcgccacgcgcctggatgagcggcgcttccaggtggtgaccctggagccggtggtgttgcatgccgaggatttcgacctggcgccgggcgtagcggcgttgcgcaaggctgccgggcttaagtcgatcagcctgtcggtgccggtgggtgcggtactgatcttcacggcgcgctgacatgagcggcgcagtgttcccgtggcgcagcgccaatcagttcgaattgctgatcgacgggccgagtttcttcccgcagatgctggtgggcattgcccgggccgagcagcaggtcgatcttgaattgtatttggtcgaagccggggcctgtgcagacgccatggtgcacgcgctggtgctggccgccgagcgtggcgtgcaagtgcgctgcctgtttgatgattacggcagcctggcgtttaccctcgggctgcgcaagcgcttgatcgatgctggcgtggagctgcgcttctacaatcgcctgaattggcggcgctggatgcgcaacctgtaccgtgaccaccgcaagctgttgctgatcgaccagggtatcgccgtggtcggcggcacgggcgtcaccgatgagttctggacgccagggcaagacagcgccgactggcatgaagtgatggtgcagatcagcggcccgctggtgctggactggcaggcgctgttcgaccgtcaatggcacgccaacgcggcgcgccgtgaatggaaaccagcgacccatttcggtttgccgcgcctgcccaaggtgcctgcgatgggccccggcctgggtcgtgtggcctatgccgacgcccgtcaacaccgggatatcctgcaatcgctgatccgcgccttgaaccgcagcaaggggcggatctggctggcgacgccttacttcctgccgacctggagcgtgcgtcgtgccttgcgcagggcggcagggcggggtgtggatgtgcgtttgctgctcaccgggccacgtaccgatcacccgtcagtacgctacgccggccatcgttattacccgcgtctgctgcgtgcaggcgtacagatctttgaataccagccgtgctttttgcacctgaaaatggtgctggtggatgattgggtgagcattggttcatgcaatttcgatcactggaatttgcgcttcaacctggaagccaacctcgaagcgttggacccgggattgacggcggcggtggtggccagtttcgaaactgattttgcccagagccaggcggtgagcctggaggcatggaaagcgcggccgttgtggcggcgggtgaagcagagggtgtgggggtggattgatcggttggtggtcaatctgctcgaccggcgcggctaacaagaacaatgaggtcaaatgtgggagggggcttgctcccgatggcggtgtttcagttaacagattcattgactgacccactgctatcgggagcaagccccctcccgcatttttttgaccgcgtcaggcgttagagcagttcaaaggtctgttgctgcacatcctgggaatccagcccgatctgcacattgaactcacccggttccgccgcgaacttgagttgggcgttgtagaacttcaagtcctcctcggtgatggtgaagtgcagcgtgcgttcttcaccggctttgagcatgaccttctggaagttcttcagctccttgatcgggcggatcatcgagccggccacgtcctggatatacaactgcaccacggtttcgccatcgaccttgccggtgttcttcaccgtgacgctggcgtcgagcttgccggtcttgttcagggtggtggacgacagcgccatgtccgccaggctgaacgtggtgtagctcaggccatagccaaatggaaacagcggacctgtggtgtcatcgaagtactgcgaggtgtagttgcccggcttgcctggggtgaacggccggccaatggtcaggtggttgtagtaggtgggaatctgccccaccgaacgcgggaaggtgatcggcagcttgcccgacgggttgtagtcaccgaacagcacgtcggcgatggcgttgccgccttcggtgccggcgaaccaggtttccaggatcgcgtcggcctgctggctctcatcgaggatcgacagcggacggccgttcatcagcaccaaaaccaacggtttgccggtagctttcagggccttgatcaggtcgcgctggctttgcgggatgttcaggtcggtgcggctcgacgactcgtgggacatgccacgggactcgcccaccgccgcgacgatcacgtcggcgttcttcgccgctttcactgcttcgtcgatcagcacttgggcagggcgcgggtcatccaccacttccggggcatcaaagttgaggaagttgaggtagtcgagcactgccttgtcgccggtgatattggcaccgcgggcatagatcactttgcctttctcgccgatcaccgcgttcaggccgtcgagcagggtcaccgattgcgcaggccggccggcagcggcccaactgcccatcatgtcgataggggccttggccagcgggccgaccagagcgatggtcgcggattttttcagcggcagggtttcgttgtggtttttcagcaacaccaggctacggcgtgcgatatcccgggcctcggcgcggtgcaggcggctgtcggcgtaggtgtcgaccgggtcatcctcggccttgccgatgcgcaggtacgggtccttgaacaggcccatgtcgtacttggcgccgagcacttcgcgcacggcgttgtcgatgtcgctctgctcaatctctccggacttgagcagcccgggtaattccttgccgtacagcgagtcgttcatgctcatgtcgatgccggccttgatcgccagcttggcggcttcgcgcccgtccttggccacgccgtgcttgatcagctcgaagatcgcgccgtggtcgctgacggtcaggcccttgaagccccagtctctgcgcagcaggtcgttcatcagccaggtattggcggtggcgggcacgccgttgatcgagttcaacgccaccatcacgccgccggaaccggccttgattgccgcgtggtagggcggcaggtagtcctggtacatcttgaccgggctcatgtcgaccacgttgtagtcgcgcccgccttccaccgcgccgtacagggcgaagtgcttgacgctggccatcaggctgtcggcattcgcggggctggtgccctggaacgccttgaccatgacttcggcaatccgcgagaccaggtaggtgtcttcgccgaaaccttcggaggtacggccccagcgcgggtcgcgggagatatcgaccatcggcgcgaaggtgatgtcgaggctgtcggcagcggcttcctgggcggcgatgcgcccggagcggccgatggcgtccatgtcccagctggaggccagggccaggctgatcgggaaaatcgtacggtggccgtggatcacgtcgtaggcgaagaacatcgggatcttcaagcggctgcgcatggccgcgtcctgcatcggacggttttccgggcgggtgatggagttgaacgtgccaccgatgcggccggcggcgatttcctggcggatcagttcccggggcatttccgggccgatgctgatcaggcgcaattggccgatcttttcatccagggtcatttgcttgagcaggtcgctgacgaaggcgtccttgtctttaagcgcagcaggctttgtttctgcccagacggggtgggtggccagagtggcaacaaggccgagcaaacacagcttcttcatgaatatcctttttcggctcactgcacagcgataacgctgatcggccaaaatgtggggagcgtctattgttgttcgggtgttgttcagataaatgcagcacactctgaactctttttcgcgctgggcatctttgtagctgattggctcgatgcatgccagtggtggcggattatgccccaagcgcgtcgtttgtagggttagtcatcaaattccatcgagatcgggcaggagaaacaccatgcaagcagcacaaacttaccgctggggcttcaaggctgcggcgttgttactgatcagcaccgtgctgagcggttgcggcatcaacaatatcccgaccctggacgaacaggccaaggcagcctggggccaggtgcagaaccagtaccagcgccgtgccgacctgatccccaatctggtggaagtggtcaagggctacgccgcccatgaacaagacaccctgaccgcggtgattgaagcgcgggccaaggccacctcgatccaggtggatgccagcaccctggacaacccggaaaaactcaagcagttccagcaagcccaggatggcctgagcggtgcactcagccgcttgatggtggtttccgagcgttacccggacctcaaggccaaccagaacttcctggccttgcagtctcagcttgaaggcaccgagaaccggatcgccgtggctcgtcgtgatttcatccaggccgtgcaagcctacaacaccgaaatccgcaccttccctggccgcctgtggcacaccgtgatgtacagcgacctgccgatccgcgccacgtttgaagccaccagtgccgatgccgataaagcaccgcaagtgaagttcaaataaggccacactgaggtgtcgatgcgtttattacggataggcctggcgttgtggctgttggcttgcgtgggcgtggcccaggcagcgttgaccttcccggcgctgagcgggcgtgtggtggacagcgcgcagatgatcgacccggcggtgcgcgagcaactgacccagcagttgcaggcgctggagcaaacctcgggcgaccagcttgtggtggttactgtgcccgacctgcagggcgtgcccattgaagactacggttatcaactgggtcgccagtggggcattggccagaagggcaaggataacggcgcgctgctgatcgtctcccgtgatgaccgcaaagtgcgcatcgaagtcggttacggcctggaaggtgtgctgacggatgcgcaatcctgggtgatcatcaatcaggtgatcttgcccaagttcaaggccggcaacttcagccagggcatcagcgacggcgtggcggcgatgatccaggtggcgggcggtgaacccttggcagtgccagctcatgtggcggatgcgaatttcgccaaggataatccagggttctccatcggtttgtttatcctgctgatcggcgtgttgtggctgtgcaatcgcatgggcctgccggtgggcgctattctgctggccattctcagcagcagcggccgcggcggcggtgggggcggcggtggcggtggtttccgtggcggcggtggtggcttcggcggtggcggggcttcgggcggctggtaatgacaataacgagaaaagagcatctataaccatggcattactgactgaacatgagcagcgccaagtcgccgaagcaattgcccgggtcgaaaaaaacaccgacgcagaactggtgaccgtgctggcggcgcgtgccgacgactacgcctacatcccgttgctgtgggccagcctgatcgcgttggtggtaccgggcgtggtgcattatttgtcgggctacctgaccatgtacaccttgctgctggcgcaatggacgacgtttattgtgttgtgcctagtgtttcgcttgcccaaggtcaccacccgcctgattccccgctccgtacgccactggcgcgcctctaacctggcgcgtcggcagtttctggagcagaacctgcaccacacgctgggcagcactggcgtgctgatatttgtcagcgaggcggaacgctacgtcgagatcctcgtcgatgacggcatttccaaacgcctggatgacagcagttgggacgccatcgtcaagacgttcacccagcaggtgaaacaggggcagacgctggccgggtttattgcgtgcatcgaggcgtgcggcgagttgctcaaggtgcatgtgccggtgacgcaaacgcgcaatgagctgcccaatcgcctggtggtactcgaatagcccggccaactcagttccaaatgtgggagggggcttgctcccgatggcggtgcaccagtcaatgaatctgttggctgacacactgcaatcgggggcaagccccctcccacatttggatctactgtggctgctggaactgaccattggtcaaataactccgtgccgttgagggttatcccccctaaaatgcccggcattctttgcccgaggcgtttttgttcatgtccgtcaccgctcaacccgccaaccctgcgccggatcatcacgcccagttcatccaattgctgagcgcaagccttgcgcaaaacgcctttatcaagctggtgctggccaagtacgtcggtgaggaagccgagctgcaacggctgatcatcaagcctgtcaccgtcaaagaccagccgtgcctgtccttcgtgtaccgctacaagacccgcgacatcaccaagaatttcccctcggccgacggcgtggcggcgattgccgagctgttgcctgcgtcattcaagaacgcgcacttgctgtcgctgaccgacgaagcccagttggaatacagcaagaagaacaaaagctcgctgttcaaaagcaaaccgcaacaattgcgcgaagcaccgtcggccgagcataaccgtgaaaagaaccgtttcctcgacctgagccggccgttcctcgtcgacctcggtgtgaccgacgccaagcaggcgctgatcccatcgatgtcgcgcaagtggaagcagatcaacaagttcatcgaagtgttcagccatgcgctgacgtcgtcgccgttgaagcttgatcaaccggtgcgcgttgccgatttcggttcgggcaagggctacctgaccttcgccatccacgactacctgcgcaataccctcaaggccgagggcgaggtcaccggcgttgaattgcgcgaagacatggtcaccctgtgcaacagcgccgccgcccgccttgagcacccggggctggtgttcaaatgcggggatgtgcgcagcgtggcaccgagtgagctggacgtaatgatcgccctgcatgcctgtgacattgccactgattatgcgattcacaccggcatccgttccggtgcgtcgatcatcatgtgctcgccctgctgccacaagcagattcgcctgcagatccagagcccggcgctgctcaagccgatgctgcaatatggcctgcacctgggccagcaggcggagatggtcaccgacagcttgcgcgcgttgttcctcgaagcctgcggctatgagaccaaggtgtttgagttcatctcgctggagcataccaacaagaacaagatgattcttgcggtcaagcgtacgcagccggtggacaacgcgcagttgctggtgaaaatccaggagctcaaggcgttctaccacatcacggaacactgcctggaaaccctgctgcgcgccgatggctacctggcctgaatacagagtttttgtaggagcgagcttgctcgcgaaaaacataaggacgcttcggggcatcaggagccctcgtgtcagcgttggcgattttcgcgagcaagctcgctcctacaggttcagcgatcagaagaaccgcgtcacgctgatcttcgcatcgcggcccttggtgtaggcgcggtcgccgctcaaggccgggcggaagttttcgttgaacaggttgtccacggtgaagttgacctcggtgcctttgaggtacgcctgctgcggggcccatttggcgaacagaccctgggtgttgtagcgcttgttaccgtactggtcgaagaacaagtcacccacaccggagcccgggccaccggagtatttatcactgggcaggcggtcggtggcgccgatgaattggcccatccagcccacctgggcatcccaggcgggaatgtgggtgcccaagaccagcacccatttggtcggcgggatatcccgtgctgccacgtcagggccccacgggttggtgtaggcgccttggtgctggcccttggcataggcgaacgacaccgagccaaacaggtaggtggagttatagatcgactccagctcgacgcccttgatggtcatgccaccgatattgcggtagttggacatcggcccgggtgggcaagccgaggaaatactgccgccgttgatggcctggttctggcaacccacgccggtggccttgaagatttcgtcttcgactttgttgtggaacagggtggttcgcagttgcaggttgtcgtcctgagcgatcaggttgtcgaagctggtgatgttgcccagggtgatcgaggtgatgcgttccgggtccaggtccacgctggtggcggtacggctgcccaggccctggacttcatattgttcgtcgatcaccggcgcacgccaggtctggctccagttggcgaacagcccgacgttcggcgtcacggtccagaacagcgccaggcgtggcgaccagcctgtgtaggtgcggtcgctgtagtcgtggccaacggccgggtcggggttgttgtaatagggcgcatcgttgccttcgccgcggttgcgcacatggtcgtagcgcagggacggcgtaattgtcacgtcgccgatagtcaccgcgtcctggataaagaagctgttggtgtcgaccttgccgtggggcatgaagcccggctggaagtgcccgtagttgtagcgcgctgtgttgtaggtggtgccgggcatccacatttcggtttcgcggatgtgtttgcggatctgcccgccaaccgtcaccgcatgctgcaaggggccggtatcgaacaggctgacgttacggatatcgaggttcttgtcggtataggacgtgtccatcttgcgcccgccggtggccagctggaaaaacgcggtggcgtcacgctcgtcggtctgctcggtgtcggactgggaatacttgatggtcaagtccaccagcgggttatccaggggctggtattcgtacttgcccgaccaagtggtgtcgaccgtgtcacggtgggccaggaaacgcttcaacgcaccttcgtagccgtagcggtcgatgttgaactgggtgggcggcgtcggatagctcgctgcggaaaacggcgtccagcggttgctatgggaacgtgagtacgacaggccgacactgtgctcatcggtgaaatgtgcgttgaccttgaacaacttgccgtccacatcctgggcgctgttgggcaggcgctgggggttgatggggtattggttgttctcgttgggcaacttggcggccaccttcatatcgccgccgtcccgttgggtcaggtaggccagggcgtcgaagcgaccatcgtcagtacggccatacaccgcaccgctgtagacctgttcatggtcattgctggagtagccgtatttgagcatcgcgccgctattgcgaccgtccttgagcaggtccggggcgtccttggtgatcatgttgaccgtgccgccgaaaccgccattgccggtgaacggcgagttcgggcctttttccacttcgatgcgcttgatcagctcaggctcgataaatacagtgccttgctggtagcgctcgaagccagtcttggtggcgccgtccacggtcagcggtacgtcttcggcatcaccgaaaccacggatgttgatggtctggccgccgggtttcagcgagccgccctggctgacgccgggtagggtctgcaacaggctcgggatgttattggactggtagcggtcgatatcggcctgggtcagggtggagcggttgaccgtgctggagttcacttcgttgccggtgccgatcacgctcaacgtgtccagctggatcgcgccgctttgggtggtcttgccctcatccgggcgcacgacataggtgctgccgaccttgatcagggtgaagtcgccattcttgagcagggagcggatcgccgcttccgctgtgtagtcaccgttgagtgccggcgcctgcaggttcttgagcaggctttcatcgaacagcagctggatttgcgcctgttgcgccacctggctcagggacgtggccagcgactgggccggcagttgcagcttgaacgactcggcctgggcgctgaggctgaaagccaggcaggcagcgatgagcgtcggtcgaagaaacaggtgcgaagcgtggcaaggcgcgcgaaacatgaaatcccccggtgcggctaagtggccaaaaaggtgtgcgtatcaaacgcagacaggaggaagacggggcaggcaaaaaaaccacacatgcgaatgcaaaatattctcatgtgtgggttatgcaggctatttgcttggctcgattctcacaatgccatcggccgacactacggttttcaccggcaacaacgcgggcagggcgctgagcagggcgtccgggtcattcacgtcaaggttgcccgacaccttgagttgggcgacggccttgttgacctgcaacggttgttggggacggtacaagctcaactcgtcgatcaggccggccagctcgcgattacgaaacgataagtgcccgctgcgccaatcggctacttcttcggcgctgagggtttgttgttgcaaggtgcccttggcgtagttgtaagcggcgcgttgtcgggtgccgagcagggtgaccgggcttttgccatccgtttcgaacgccacttggccatgggcaacactgaccaccagttgctgttggccgcggcgcacatcaaacccggtgcccaccacccgtacgttcgactcgccggcctgtacgtagagtgggcgctccttgtcggcggccacttcgatatacagctggcccttgtccaggtgcaggatgcgttggtgggcgttgaagtccacacggatgcgggtgttggcattcacatacaaggtgctgccatcgggcaggttcaacatacgcatgcccttggcctgggtggcgatctgggtgtgatacagctcgcggggcgcgccgagaggcgtcgccagcaccgcgcagagcagggcagcggccaccgccagggcagggcgccagaggctgggctcgcgctggggcagtggcatgggtttgttcagttgctgcaattgggcgaggtcggcccacagctgttcgaattcggcataggcgcgcgcgtgcgcaggcacggcctgccaggcggcaaaggctttgcggtcggcgcggctcgcctcgttgccgttgcgtgcaaaccagctggcggcttgggcgtcgatggagtcacttgcttcgatgtccagggcgtcgatgtcgctcaggcggttcattctggctgctccgtgccggggtcgggttgaaggcgccgcttgcaatgcagcagggcaaaggcgatgtgcttttctaccatgctggtggaaatgcccatgcgctcggcgatctgcgcctgactcaggccttcgaagcggtgcagcataagggcttctcgccggcggggcgagagttcggcgaggacttctttcaactgttccaggcgttgcaggcgcagggcggcggccatggggtcgtgctgctcatcggtgaccggctcggcatccatttcggcggggtcagagtggacggtctgccgtaccttctgtttgcgccagtgatcgcgcagcaggttgcgcgccatctggaacagaaaagcccgtggctgctcgaccttggcccggtcgcggtagcccagccattgggtaaagacatcctgggtcatgtccgccgcgtcgctggcgttgtccgtgcgtttacgcaggaaatacagaatatctgcataaaacccgcgacaggcatcggccgacgacgggtcgggcttgggacgagacatggatatccttcttgacgaagcacgacgtggaaaagtcgcgaatgatatcgagaattattgtcatttgtctctatttaaagaatttgctcggctaaatgtgggagggggcaagccccctcccacatttgcttagtgtcagcgcagcaatgtcttcaactgctcgatcccggcttcacccagcgggaataccggcaaccgaggatcccccacctccaacccggtcaagcgcagcccggccttgatcgtcgccggcaacccacccttgagaatgaattgcagcagcggcaactgccggtagaacagttcccgcgcctggttcaagtcattggccagcactgcctggtacaaatccaggttgagttgggggatcaggttcggcgctgcggtgcaccagcctttggcaccggcggcgaaagcctccagggccagcgggttgcaaccgttgtagaacggcacgtcactcaggagtttcagctggtgcatgcgctggatatcgccggtgctctccttgaccatggtcacgttgtcgacctgcttgaggatgcgcaggatcagctccaccgacatgtcggtgccgctggtggccgggttgttgtagagcatgatcggtacgccgatgctgtcgccaatcgcggcgtagtgggcgaggatttccgcgtcgctgagtttccagtacgaggcgggcagtaccatcaccacatcggcgccttgggcttcggcatagcgtgcccggcgcacggccttggcggtggtcaggtcggacacgctgacaatggtcggcacacgcttggcgactttcttgatgctgtaggcgctgacttcgtcccactccgcgtcgctcaggtaggcgccttcgccggtgctgcccaagggcgcgatggcgtggacgccgctgtcgatcaggcggtcgatggagcgcccgagggcgtcgaggtcaatacgctggccgtcggcgctgaacggggtgatggtatagccgatgatgccgtgaatagttgggttggacatgggtgaactccggtcagaaaggggcaatcagttcaggcaatcggcatgcttgcgcaggttctgccgggcgtaatagttgaacgcggcgccgtggcgcttgggcttggagatccagtcatgggcctcgcgccccaactccggcaggatcggcttgacggtgcctgcggccatcgccagcaactgcaacttggccgcacgttcgatcaactgtgcgatgacgcaagcctcttcgatgctggcgcccgtggacaactgaccgtggtgcgagagcaggatggcgcgcttgtcgcccagggccgtggtgatgatttccccttcttcattgcccaccggcacgccgggccaggcttgcaggaaggcgcagtcttcgtacagcgggcagaggtccatgtgtgacacctgcagcggcacttccagcatcgacagcgcggcaatgtgcgtcgggtgcgtatggatgatgcagtttacatccggccggccgcggtacacccaggtatgaaaacggttggccgggttgggaatgccatggccttccaacacttcaagatcttcgttgaccagcagcaggttgctggcggtgatttcgtcaaaacccaggcccagctgctgggtgtagtaggtgccaggggtgggcccgcgcgcggtgatctgccccgccaggccggaatcgtgaccgtgctcgaacaggattcggcaggtcagcgccagcttttgccggtcggtccacgtattatccgccagattgttttgcatctggctcagggcttgcttgaccagttggtcttttgggagtgctaatgtcttggccatatcggtgtcctttgggtagttcaatggacgtcggatttgctgctcgcccgctgctcgcaaggtcgttaggtgaatgcaaatgacacgaatgatgctatatgacactttgtgtcattggcaagcacggctcatcgctttctgcagggattaaccgcagcaaatgtctatccgtttgaaattattgagaaaaaaacttggcgtgaccctggaagccctggctgaaaaatccgggatgaccaagagttatctgtcgaaagtggagcgcgggctcaacacgccctccattgccgctgcgttgaaattggctaaggcgttgaacgtgaaggtcgaagagctgttcagtgaagacaaggtcagcctcgacagctacagcctggtgcgcagccacgaacggcccgacacctcgccgggctatgcggtgctggcccatcaagtcagcgagcgcagcctgctgcctttcatcatctaccctccggcccaattcaccgacaagaccttcaaggagcatttgggggaggagtttctgttcgtgcatgaaggccgggtggaagtggatttcatgaacgagcgggtgttgctggagcgtggtgacgctttgcatttcaatgcgcagaagccccaccgccttcgttcggtgggagaggtgcaggcgcagttgctggtggtggtgcacagttcggaggagtgacgcttgccgcaacctgaaatgcagtcagtgtgggagggggcttgctcccgatggcggtggatcagtcagctcatctgtagctgacgctctgccatcgggagcaagccccctcccacagttgattttctttgttcactggatcagcgttcgaccgggactgaaagcgtcgggttacccagcggatgggtgcgtgctacgaagaacctcagcgttgcgccactgccctcgaacaattccaaataccgccgcttctgctgacggataaacccatcgctgcgccccgacaccgagatcgccagggtgctgatgctggcttggcgaattgcatccaccaggtgtttatcctgcggccccaagtcatggccgaagatgcacaacgcgccttcatggctcagcaattgctcataacagaacgacaggtaatccgagctgcggatgctcttgagcttctcttctaccttgccttcactgacgaacagcggcacatcgtccagggtcttgatcgtgttgttgatcgcaaagctgctgagcaaggtgctgtcggtggacggcagcttgcgcgccgtgccatcgaggttgcgcaccaggtgcaggccgccgtgcaggtagaggatgcgcgtggtatcggtatgggtattgcgcaggtcgaagcttgagtcggcgctgcggaacaggtcatcaatgcccggcgtgtgcaggatcgcccagtagttgagcaagtcgtagttgctggtgaagacggtggcgtagttggccaattcagcgttgatcgtcgtcagcgtcgacggctgcaccaggcgccagggaatgtgtacggcatgaatggtgttgatcagcgcttccttgatcgcgtagtaacggttacgcggcgccgccgaactcaccgccagggccttgttgacccggctggtggtcttcaaggcgcccagggcttgttcgaagctgcgggtttgcagggcgtcaaatacgctgagttcggattggctcaggggtttttcttcaacggtgcgggcgttttcgaacagcgagtcgtaggagaagtcttcccaaatcgtccgactggcaccgttgccgatcagaatcccgctgaagtcgagggcagcgcgcagggcgctccagtcttcaaggtgggcgtcaatatcctggaaatccttcattgcggcgggtctactcgaaatcggctgggtggtgactttatcacgagccgacgttgatcctgatcaagatgcgccatgcggtacaggttgattctgtgggcatgaagcctctgaggattgaccatgagcagcacgttcttcatccccgccgtcaacatcatgggcagcgactgcctcgacgaagccatgatcgccattcgcaattatggctttcgtaaagccttgattgtcaccgatgccggcctggccaaagccggcatggccagcatgatcgccgagaagctggcgatgcaggatatcgattcggcgatctatgacggtgccagacccaaccccacggtggaaaacgtcgagaagggcctggcattgctgcagcaaaatgcctgcgattttgtgctgtccctgggcggcggctcgccccatgactgcgccaagggcatcgcgctgtgcgccaccaacggcgggcgtatcggcgattacgaaggcgtcgaccaatcgagcaagccacaactgccgctcgtagctatcaacaccaccgccggcactgccagcgagatgacacggttctgcatcatcaccgacgaaacccgccacgtgaaaatggccattgttgatcgcaacgttacgcccctgctgtcggtcaatgacccggcgctgatggtcggcatgcccaaggggctcaccgctgccaccggcatggatgcgctgacccacgccatcgaagcctatgtgtctaccgctgctacgccgatcaccgacgcctgcgccatcaaggccatcgagctgatcagcgccaacctgcgcttggcggtgcgcgatggcagtgacatggcggcacgggaaaacatggcctacgcgcagtttctcgccggcatggccttcaataacgcgtccctgggttttgtgcatgccatggctcaccagttgggcggtttgtacgacttgccccatggcgtgtgcaacgcggtgttattgccccatgtgcagagcttcaatgccagtgtcagtgccaaacgcttgagcgacgtggcccgtgcccttggcgcggatatcaagggcattacggtggaagagggggcccaggcggccatcgcagcgattcgccgcttgtcccaggacgtggatattcccgctggcctgcgcgagcttggcgccaaattgcaggatatcccgctgctggctgccaatgcgttgaaggacgcgtgcgggctgaccaatccacggcgagcggatcagcggcagatcgaagagattttccgtagcgcgttttgatagggggcagcctttagccgcaagcgttaagctacacgctgaacgcgtttaacttgagcaagcttgcggcttgccgctgaggtcccctaatgagagttctgttattcggcgccaccggcatggtcggccagggcgtgctgcgcgaatgcctgctggcggctgatgtgcaggaagtcgtcgccgtcggccgtacgcccctgacccaggaacacggcaagctgcatcaggtgttgcacagcgacatgctggatttccaacccctggaaaacctgttgcaaggctttgacgcgtgtttcttctgcctcggcgtttcctcggcgggcatgaacgaagcgcggtacacccacctcacctatgacctgaccctggtcgccgccagtacgctggcgcggcttaatccgcagatgacctttatctatgtgtccggtgccggcacggacagttccgaggcgggcaagtcgatgtgggcgcgggtcaagggcaagaccgagaatgccttgctgcgattgccgttcaaggcggtgtacctgttccgtccgggggttatccagccgttgcatggtgtgcgttcgaaaacgccgctgtaccaatctttctacagcgtgctcgggcctgtgctctcgtttgtgcgtcgggtaaaaccggcgtgggtggtaagcaccgagaccgtcggccgggcgatgttgcaagccgccagccatggcgcgccgcagccggtggtggagcaggccgagatcaatcgcctggctgccgagcgccgttgaggttgcacaagcgctcgatctgatcaactcgcagttgccagcgcccgggcgggtgcggcgctgaattgaatcaacgccacgccgccgatcaacaacaccgcccccagcacccgtggcgtattcagttggcgttccgccaggccgaacagaccaaaatggtcgagcagtaacgacgcaagaatctgcccggccatggccaacgcaataaaccccgatgcgcccagcttgggcagcagcatcaacgccaacgaaataaaacacacgccgaacgcaccgccggcccacatccacaagggtgccttgctgataaaagccaggctcggcagcggtaaacgcagcgccaccatcaccggcagcagcacgatgatgcttaccagcaatgacgccagggtggcccacaacggatgcccaagcccgcgcccgaggttggcgttgatcgcgctttgaaacggcaccaccgccccggcaatcaccgccagcgctaacaaacccagccaatgcaacgtcgtcatctcacatctcccagaggttttgctggactctaggttattcgtcacgcaaatttaaattccaaattcttatgccgagcatgcagctgatgaatgacctgcgccgcatcgacctgaatctgctggtgatcctcgatgccctgctcagcgagcaacatgtcacccgcgctgccgagcgcctgcacctgagccagccggcagtcagccatgcgttggcgcgcttgcgcgatatgctcggtgaccctttgctggtgcgccagggcggtaccctggtgccgacgccccgtgctctggagctggcggcgccgttgaccgaagcccttgcccaagtgcaggcgttgctggcaccgaatcgttttgacccggcttcggccaagcgccggtttcgtatggcgatgtcggactacagcgcggcgattatcctgcccagcttggtccgtgccctacgtcatgaagcacctggcatcgatctgcagatcatccacgccagccgtgaaggtatggtcgacggcgtgctcaatggcgatctcgacctggcggctggcgtattccccgatatgcccgtcgaactgcgtacaacgcttctgttcgaagagcattacacctgcctggtcgaccgccacagccttgcacccagcggcgtgctcgacctgccgacttacctggcgcgcccccatgtgctgttggagatgcgcggcagcggcacgccggaaatcgaacgggccctgcgcgcgatacgtgaacggcggcatgtggcgatcagcctgccgcattggggcgtggcaccgcagttgatcgagggcacggacctgattttgacggtgtcgtcccgcggtttactggatatcgatcatgcacgcctgttgaccgtgccgccgccgtttcatattccgtcctttgcctttgagctggcctggcatgcgcggcggggtggggattcggggttgcagtggttgattgggcgggtgcggagtgtattgtcagacggtcaccaataaccacgggaaatctacatgctcagcggctttaaccacctgaccctggccgtgaccgacgtgccgcgcagcgtcagtttttatcatgagttgttgcacctccagcttgacgccacctgggacaacggtgcctacctgtcattacccggcctgtggctgtgcctgtcactggacccgatgcgcccgcccgtgccggcagccgactacacccactatgccttcaccgccgacgccactcatttcgccgcgctggtcgagcgcctgcgggcagctggtgtgcaggagtggcgcgacaaccgtagcgaaggcgcgtcgttttatttcctggatcccgacggccacaaactggaggcccatgtcggcgacttgacctcgcgcctgcaagcctgccgcgccaagccttatgcgggaatgaagttttacccgccgtgctgaaacatgcagaatcaatcaccttcacacgtctgtcagagcctacctatgaccccctccttgctgctcgccatccttgcatcgggttttatctacggtattacccccgggccgggtgtcttggctgtgttcggcatcggcgctgcccgtggtcgacgtgccggggcgggtttcctatgtgggcatttgctcggcgatgtggtgtggtgcagcacggcgctgattgccatcgtcggtgcgcgggaagtcggcagcagcgcgttcgatgtattgggcgtactcagcggtgtgtatttgttctggctcggctggcgtgcaatccgcacccagcgccgcagcagcgatgcgcctcagggcgcggcgcggcatccgttctggcatggcattctgttcggcctgaccaaccccaaggcgtacccggttgccgtggcgaccttcacggcgttgctgtccagccgtgcggagttgctgacctggtcgatgctgccgtcgctgattttcctgagctttatcggtggcctgttggcctacgcgattctgatcggcgtggtcggtgcccagcgggtgcgtacggtgtatcagcgtcatgaaatcctcatcacccggctctgtggtgtgatgtttattggcttcgccatcaatgccttggcgcacgcgctgccgggcctgttgggcaataaatcggcctgaagcatccacgaccgttcgtcgcactggcaggttttttctaaacctttgccgcgcaaaaaattcgaactcagggcggggcgtgttttccccgcacttatttttgccctggaggaacccatcatgagccgcatggctatccggttacgcaccgccagtttcgcgatgctgctgggcctcggcgccagcaatgctttcgcccagtcgcctgccgaattcatcgagcaggcttcggccaaaggcatggccgatatcgaaaccagtcgcatggcccacgccaagacctcatcccaagagatcaaggattacactatcgaggtcattaacgaacgtaccctggccaaccagcacttggcagctatcgccaagaagctcgacttgccggtagcacctcgggaaaagatcgttgataaagccgaaaccctgatgcccgaactcaaggacggcgactcctttgacgctgcctacaccgcgcagcaggtcaaggaaaacgaagacgccatcgccctgttcaagaaagaaggtgcggcgtcggatgtgccggaaataaaagcactggtggatgaaacgctgcccaagctcgaagagcgtctgcaaaaagcccgtgccttggcatcgacctatggcaaggggcatcaaggtgatggctgaggtccttacgtgaaataaaaaaacggcgattggatcactccaaccgccgtttttttcaggcctggttcaagtcagtcttgatctgcgctgcatcgtcggccacggccccgcaactgctgttcaaactcaccttgtcgctgctgccaatgctgcggtactccttgcgcagtctttcgagttccttgcggtccaggccatccaggctgagcacggcattctgtgcgtctttggatgcgcgcaacagttcatcgatcttgatatgcaagatgtcgttatcacggttctgcgtgttctgaatcaaaaacaccatcaggaaggtgatgatggtggtcgaggtgttgatgatcagttgccaggtatcgttgtagtggaagtacggcccgctcaggctccataggagaatcagcgcgactgccgcgtagaaggtcttggggctgcctgcccaacgtgacagggtttgggagactgcagagaatttcatgaccgttttcctcaaaaagggtgatgaaaattctgaccgcgggcagtcgccgaaatttctttttacaacttagcgtttgaacaaagttgtgcgtttttctgccaggtatttaagcaggaacctacggcgtcccaggacggccagggcaagactgggttttttctggataccgcctcatggatgccaatcccgcctttgacctggtcacgctttatcatctgaccgaggaccactattttgccgccacctgcctgacgcaccgacgctactgcgcagccatcaatgcctattttatcgacgagcatgatttcccgtggaatttgctgttcattcgcctgggcagcgccccattgggtgaggaaatggctgctgccctcgagctgatccgacgcaccccgattgaagtacgcctagtgattcatgagcaaaaggtcgagggcttaggcgaagtgctcacggggctcgattttcaccccgctgaaaagaccacggcaatggtcctccaattgtcagcgcttataccgtcagagggtgagggcgatgtgcacgtccgcctgacacgggatttgaatgagtgggccgttccgcttggcaatgcgtacgcgatgctacccgaagtggttgcgcattatcaggcccggcaccagagggccctggacgctgatgaaagcctgtatcacttcaccctgtgcgccgaagggcaggtaagctgctcgttgaccttgtctctatgcaatggtgaggcccggcttaatgatgtcggcacgcttattaacttgcgtggaagaggctatgccacgcgtttgattcgagaggccctgcatcatgcgtcgagcctgggcgcccagcgttgctttctcgaggcatcggagggcgccgtcccgctgtatcgcaagttgggtttcgaacgtttattcgactatcgggcatttgttcgcgtggctttaccaggcctatgatcagaaagccattttgatttggccgcgatcttcgagggtcaatagatactgtttggcctcaagccctcctgcaaacccggtcagcccgcccgatgcacccactacgcggtggcacggcgcgatgatcgagatcggattgcgcccgttggcggcgcctactgcgcgcacggccttcgggttgccgatctgctgggcgatctggctgtagctgcgggtttcgccgaacggaatggtcaataacgcctgccagacttgcttttgaaagtcggtgccgatgaagtccagttccagctcgaaccggttgcgcgttccatcaaagtactccctcaattgacgctcggtttccaacagcaccgggttgtcgttggcctcgatcaattcgcccaggcgcacgcggttggcacgttccacttcccacaggatggcgctgagcctgccattgcgcgtcaccagggtcagttcaccgacgggggaagtcatgagcttgtattggtatgtcacgagcaggctcctcgaaagggcgttaatggggacaacgctactgtagtgccagatgccggcgaggaaactgcgtttcttgcggtcaaattcttcgccagcctagaagttccagtaaacccaattggaatagtacgggtaccagtaaagcctggagatatagtagagccccatcagcactgaggctgtactcaacataaacgaagaagcgacattgagcagagtgacaatcaacgcgaatacagctacgcgtcgggttgcatgaccccaggcaagctttacgccataagccgacgcaacaagcgctcccgtttgaaggagcaatgcaagaggaaatggcagccttataaacgaaaccagtagcggcaaaaccaccacccagcccaccacttggcgcaggattggtttaggcgtgtgctgtttgctttcaaccatcgcaaagcttccgaggtccaggtcgacaagctgacatcatcacccatgtggtttcgtcactgccataagtctttacttacctaccagcggaatctgtgcggttttcagtaggcgttgaatgaagtgtatgggcgcgcagaaaaggcgccgtggagaggtattgcaagggttttcaggggttaacgggtatgcagtgactgctcgagtacgccaagaaatgcatccgccaacacacttcttgctgatgccggggtcagtaccagcaattgtgcacacgcatccacttcctgcattggcctataggtcacacctgtgttcatcagactctgcgtacagtccggcacgagcgccacgccctgtccggccgccaccagggcgatgatcgaagtgatctgccgcccggtcggcccaggccgcagcggatggccgtggtggcggtaaagtcgctcgatggactggttcaagcctgacccatagtcagcgggaaacagaatcagcgggtaagtgcttagttgcgccaggctgaccgtcgcctggctcgccaacgggctctcgctggagaccgctgccaccagccgttcttcacctagtgacaatgcctggacatcagtgctttttggcaacagccggctcaagccgatatccaggcgcccatccgccacctgcgcgcccaggctgccggacgcgcactccaccaaggtcagttgcacatcgggaaagcgctgggcgaaggcctggatggcgcggctgaacaggtctgacaaggcgattgagctgacatagcccaatgtcagctgacccgccgtgccggcagccaatttaccggcgatcacctgcgccaactccacctgttccagcacgctcctggcgtagggcaggaacgcacgtccctgggcggtgagggtgaccgtgcggctggtgcgatcaaacagcttgaaccccaattcggcttcaagggcggaaatctgccggctcagcggcggctgggccaggtgcaggcgaagggctgcgcggccgaagtgcaattcttcggcgaccgtcagaaagtaacgcagcttgcgtaggtcgagcatcctggtccttgggtatcaatcggtcggaattcggtattggtttaagagctacccggcattctataaagacctcacaaaataaaacgagaggtttcatgaaaccacgcctgcattgtgcccgccttgccctgttcctgtgtggctgcgcggcgtttctcaatctctacgccacccagagcatcctgcaggtgttcgccgcgcaatttcatatcagcgccaaggccgcgggatggagtattaccgtgaccacactggccgtggcgatgactgcgccgtttgtcagccgcctgacccggcacttcgagcagcacattgtgatctcgactgcggcgttgctgctggccgggccggtgctgatgacggcctatgctgacagtttcgcgcaagtgctggtgtggcgctttgtcgagggcatgttgatcccgtttgtgtttgcctccagcgtggcctacatcggcgatcgctggcgcggcggcacggtgaccgaagtcaccagcctttacgtggcgggcactgtgttgggagggcttggcgggcgcttcatcaccggggtggtgactgaatatgtgggctggcgtgaagcgtttgagtggctggcggtactgagcttgatggtgggcggttttattcagtttctgctgccggccaaccgcccgcgggcgcagcaagtccaagcggcttcgtcaggcgtttggcgcaagccgttgctggccgcttatgccgtaggcttttgcgtattgttctcgcaagtcgctgcttttacctacgcaggtttgtaccttggcctaccgccgttcaacctcgggcctgccgccttggggacgctgtacatggtgtttctgttagcgttggttgtgatccccattgccggccgcctcagtaaagcccgcccgcatgtcgaattgctgagcgttgccgccatcttgggcgtctgtggttcggccctgaccctggtgccttccctctggtgcattgtggtgggcctggcactcagttctaccggcgtgttcctcgcccaagccactgccaatgccttcaccaccaccaccgctggcgccgacaaggcagcggcggtgggggtctatctcacctgttattatctgggggggagctgcggcgctatcgtcccggcactgatctgggagcgctggggctgggccggttgtgtggggctgatcattggtttccaggtgctgaccctgttgatcgcgctggccggctggaagccccttaaacctgagctgatccgcgtaccatgacccataaaaaaaccggccaccaagggccggttcttatgcattcgcgccagaaccatcccgacgcaagcgcaaaatctgagtggagcgggtagagggaatcgaaccctcaactaaagcttgggaagctttcgttttgccactaaactatacccgctcagagcggctgactttgtaccagatgtccgccaggatttgaagtttttcttcgaaaaatgtgcgagttgcatgtggcgagggcgctcgctcacgctggagtgcgaagcgctcctacagacagtggatctgcttcgcaccccaatccgttcccgtcagccttcatttcagatggcaaacgcctgctgggcatgaccctgctgataccgcaacctgctaacctgccgctccggtttcaagaagcccaccaccgcctcacggctgtccctacacgccgctttatgctccatatccaggaaatgccccgtcgcctggatagtgctgaagctgctcttggccacatgctggccaaacagcttggcatcttcggcgctggtgtattcgtcccattcaccattcaggaacagcaccggaatgtcgatctgtctcgccgccttgaggtagcacaaccggtcgctgttgagcacgtggctgatgtggaagtgcatctgcccgtattcgtgctcggccaggttgctgacgtggcggtagttgaagcgtttgaacagcgacggcaagtgtttgccgatggtgctgttgaccaagtggccgacgcggtcgcggtcgaggttgccgaggtagtcgacgccgcgttcgaggtagtcacgcatgggggcgttgatcactggcgagaatgagctgatcacggctttctccacgcggcgaggccggtgcgccagggcgaccagagtggcagcgccgccccaggagaaagacagcacgtgctcggcggcgaaatggtcgagcagttccaagaggatctggccttcgacttccttggtcagcatctgctcatgacgattatggattttcgagcggccagcgtagggctggtcgtacaaaaccacattgaattgcgggtacaggcttttcacggtttgagcgaaggacgccgtggtcgccatggagccattgaccaggacaatggtcttttcagctgcgtccgcgcgatagaactccgtgtacacccgatactgcccctgtatatccagcacagcgatttctggcctcatgtcgtaagactcctggcaagcgggtagtgcgcgcagatcactctgcacgagctttgtgacaggtaggcatacgcctggaaaatgagggcccctgtcggtccgatgacggctggccgacgggtattgctagggtgggctgtttgccgtgaaggcccgtagatcaagggcgggccaggcaaaatgtttcttggaggttatagggtgactcatcagtcataaaactggttgatgccctgattcaagcagtacagtcggcacgtcgcaaggttaaagactggtttttggccatcaccggctgaacggtcgtcagacttgtcggatttcttcgtcagtcaatggccgatattggcccggcgccagcgccgcatccagtaccaaaggccccattcgctcacgatgcagtccgatcaccttgttatcaaaatacccgaacatgcgcttcacctgatggtagcgtccttcgatgatgctcaaccgcgccgttcttgagctcagtcgttcaagctcggcgggttgggtggtgaggtcttcgaaggcgaagtacacacctgcggcaaacgtcgccgcgtactccgggccgatgtcctgctcggtttgcacgtagtaaaccttgggcaacttggtctgtggttgcgtcaggcgccgcgaccactggccgtcgttggtgatcagcatcaggccggtggtattgaagtccaggcgtccggcgatatgcagttcggccttgtccggttcatccagcaagtccaggaccgtggggtgttgtgggtccgaagtggcgctgacgcaaccctggggtttgtgcagcatgaaatagcgcgccggtttacccgcctgcagtacggcgtcatcaacgcagatcaggctgaattcacgcacgtcatgatggggatcgctgaccgccacgccatcaacggtcacccggcgctccgcaagcagcaggcgcacttgctggcgattgaactgcggcaggttgctgaggaaacggtcaacgcgcattgcgctgacgcaactggtcgtccacgtgggcacagcgcgggcacaagcaggcttgattgcgcacttcatcaggcagggcttcaagcaccgccgggtcgatggtgacgttgtagcaccagcaggcttggtcggcggtacgtgggtcggccagggtgcagtcgttgcgggcaccgcaggcggggcagagggttggcgtggtcattggtcggttcaggcaggcttcgggcagggtcgcgcaagttcttgcacgatacagggctgctcagtcgcgttccatctccctgtcctgaagaccggtattcaattcgtctgaaacagatgtttctacttgtgtcgtcagcgcaccagattctgtttttgatgtcagatatttcgtcattcagtgaaagctgaatgccgcttcccagcgtcgctggaggagctcttccgcggtccaggaggccgccatgtatcgacgactgctgcttatcgctttgctcggcctgaccctttgcgcctgcgtgccctactacgatggaggctctacttactaccgttccgaggtctacaccgcacctgcgccggcctattactacggtggcccgcgttactccccgtatgggcgcagttactacgctccagcgcctcgctactatgcgccaccgcctcgttattattccgcgccgcgttactaccagcccgcgccgcgttattaccctagggccggttacaggccctatcagaaccagggatggggcaatcgctggggcaacggtgggtatggacggggctccgatcacggaggtggtcgcggcggtcaccgttaaatgttttgaaaaacaagcggcgcctgatgcgccgctttttttaaccgtttgtcggtactgtcagatttaacagctatctttgggtttctagatgcatttcactatgtgaggctgtgtatgccccgtagagaaaatgggtgaatggaacctgctatgttcaaacgattgatgtgtcttttcttaatgatgggcagcgttgctgccctggccagagcggaacaaggttgcccttatcccttgatgatcaagcatgtcgatgagcattttgaagtcgtggataaaaatgtgctgtggcagagccagaaagtcgagagccgcgattttatcgaccggtttatcggcgccttatttaccccgggcaaaggtgaggaacggcaaggcggctacatggacaaatgtatctatcgaactggcgggggcgacgttgtcgccttgagaccaagcccgcctggcgttccgaccagcatgtcattgactgatacgttgtattggcggctagacaaagatctattcggccaaccggtttatttgtgtgacgaagggccgccggataactgcgccttcaaggtagccgacaaaaaacgtaaagctgtcaaaagtcggataaatccgccagaggattcctaccttcccacgccttattgaagtgcgcctgcaccactgcttccggaagcgtgttgatatccggccaatgccaatgaggcgcctggtccttgtcgatcaagcgtgcccggaccccttcggcgaattccgggtgacggcagcagttgagactgatggtgtattccatctggaacacctgggccagggacagatggcgggcacgctggatctgctcccagaccagatgcgccgtcaaagggcatccttcactgagggttttgccggcgcgcgccaatagcgggtcgctgtgatcacgcagcaggctcaatgcacgccaggcacagcgtacatcccccacatccagccactcgtcgatctgcccgcggcgtggcagccactgcgcttcgggttgctggctctccgcttcctgggccagggccttgagcaagctgttgagctgcatgacggtctgttcctgccagttcagttgcagcaggccattgagcaattcgtcctgctggtcatcacgcaggaagcggtcggccaggcccaggtccagtgcatcacgaccgttgatatgggcaccggtgaggcccaggaataacccgagcttgccaggcaggcgggaaagaaaccaactggcaccgacgtccgggtaaaggccgatgctgatttcgggcatggccaggcggctggttggcgtgacgatgcgcacggaagcgctttgcaacaggcccatgccgccgcccagcacatagccgtggccccagcagatcagcggcttggggtaggtgtgcaggcggtaatcgaggcgatattcggcagcaaaaaactgcgcggccaaggccgggacttcgccgggttgttcacggcattcctgggccaggctgcgcacctcgccaccggcgcaaaaggctttgggcccattgccgcgcaacagcacgcagacgatttgcgggtctttggcccaggcatccaggcggtcgctcagcgcgaggatcatcggcagggagagggcgttgagggtcttttctgcgtccaggctggcgatgccaatgcgggcaccgccactgccggtcagttcttcgaagtgcaggttcattgtgacctcaatcgagaaggtgaaggatgagtatgatcccttcttgggaaagtgccggtggtgtgtcagatcaattgacaagcggagtcggctttcctagggttcgcctcattcttttttacaagacaattcaactatgaccgatggcgaccgtatcaaactcgaacccagctggaaacacgccctgcgtgatgagttcgagaagccctatatggcccagttgcgcgaattcctgcgtcaggaacatgccgccggcaaagagatctacccgcccggcccgttgattttcaacgctctcaactcaacgcccctggacaaggtcaaggtcgtgatcctcggccaggacccctaccacggtcccggccaggcccatggcctgtgcttttcggtacaaccgggggtgccggcgccgccgtcgctggtcaatatctataaagagctcaagcgcgacctgaacatcgacatccccaaccacggctacctgcaaagctgggccgaccagggcgtgctgatgctcaacaccaccatgactgtagagcgggcgaatgccaatgcccacgcgggcaagggctggcagttctttaccgatcggattatcgaggtggtcagtgagcatcagccccatctggtgtttctgctgtggggcgctcacgcccaaagcaagcagaagctgatcgacgccaccaagcatctggtgctgacgtcggtgcatccgtcgccgttgtccgcgtatcgcgggtttctgggatgtgggcatttcagccgggccaacaagtttcttgagcaaagcggtgagacaccgattgattgggtgttgccgcctgtctgatacatgcgaggcgtgctatgccgtctcacatctgcaattcgatgattcgaaagaattttatcgttctagccaagctgaacaaaactgcacgggacgcagcacctgttagttctgacagtatccgcttgggggcaaattgccttaactactctccgtgatctttggatggggtcagtaccctttaggtggtcgaaggcctcaacctgatagtcgtctaggagagtcgatatgtctgagtacgatccgcttaacccgccttccagtcgtggcacaaaagcaggtgtgctggtcctggatgcacctgttgcacctgatgcattaccccttgaggcagatgaccgcggtcataaaataccggtattttttcaaagcacagggctgagggttgaagtgcctacgttgtggcccggcagtaatgtgcttgatcctggggatatcactcttgtcaagtggttttttgaggccgatatgtttgatgagaagaggctgacggcgccttatgacgctagcgacctgcctgacgttgacgctctggtacccccccatctcatggacgtacccggcctgcatagattgcgctacgaggtgatattaagagaatcaagtggtaacccaggggagctttcgttttcgacaattctggacagtgacaaggtcgggccaaataacggcttgcgtggtccgcgtttccagttcccgcaggtcatcgaagatgacggcgtaacggatgaatatctggataatcccgccaacctggacagagtgaccgctaccattgatttgatatggccggacatacgtttgggggatgtggtggaggcttctttaataccactgccttttctcaagcctttgcgcaaacgtccacgccatttggacatcgttgccaccaccaccattgttcaagcgcacaaggatggggttcggcccattgaggtgcatttcccgggcgcttttcttcgcggtttgcccaatcgggagttcaacgctcagtactatttgaaagaccgctcgggtcgtgagtcgggcccatcacgtaccgctcccctgttaatcaatctgacgcctacgcccaccgacctggatcctgttcaaattccgcagttgaatgatgggcgtatagccctcaatgacgcccgtgctgaaggcggggtatatatgaatatcctcgaagtattcggctccacagagggggatcatctcctaccgtcatgggatcttataccgcttgaccccatcgttatttcagcttttcaggtttggcctatcagggtgccgattccgtattcggtgttggccagcggcggttacgagttcgtttccgggattgtgagggcagaatacagttggcagagaggcgttgccccctccaggccatcgatcacccgctttgctcctgtggatctgacggttgccgggccggtgagcccgaataacccaaaccctatcaacctattgctggacgtggtgacagtgaagggggtagatggtgacaaccaattgactatcaacgacgagggtaagccggtacgcgtgattacctcgttgtatggcgcgcccgatgttggtcaaacgttggaactgatggcagggagctttcccgggcccatcgcgacctacaccgtacaagcgggagatagcgcgggtcgggaaattgagtggttcgtcgactggaacatcatcgagcttttagatacaggttgggttcctttcttttactggaccttcaacggggtcaaccggcaacgcgcgccagacacaccggtaatgatcaatacggtgcctatcgttgggctcaaaccccttgagtatgtcggagtcaactacggacctggcccggacgctgggtttatcagctgccatctgcgaccttgggtaaacggagccggcgttaaaatacccggggatccaacgctgttggacggcggtgatgaggtgattttgcactgggccagttatgcgcaccctaatggtttcgccggcgctgtcattcctgacaccatcaagtccttcagccatacgctgacggaacaagaagcccgtgagggatatgtctttcaggttccatttgacccatacatcttgcttccagggctgatcaagccaccagaagggcaaaccaaccctcggcatggctctgcggttgcgcgctatcagatcatcaaaccggcaggtgcaggcatggggtattccgagcgtaacttggtgttcatcagattgattcggcccaactcaccgccttgcgtgtcggacgattaggcgtagtggagaagggtgcagtgtgcttgtagtggaggaggtgctcgtggttgcgagcatcacagtcgagccgcaaggggtactgtcaagtttgacagttacgcgttaaagggaaatgccattaaatgaatgagaggccagcagatttgccaattcagacctctgcagggtcggcatacgtttagaaaatgacacccgggtgtttagtcttaccgtcgttttatgcccggacagatacttattcttttgaggagtttgaatcatgtccaacacatccagtaaacctgttagtcaagaccctgtaggccccatggaagagtgggaagaacccgttctcgatcccacatatttacctgctccgacgatccctggtttattgccggccattgctggcgacaaccaccggaatgtggtgccaagggcgcttcaattgagcggactcagtctaagggttgacctgtgggaccgtaccggcttttttaatgacttcgatatactcaccgtctctgtgaatggccggccggtacatattgagacctacgacgcagctgtcactttacctgatccggtaattgtggatttgggccccaagtcggccttgcaaaccaacggtgtcaaagacatcagcgttcatgtgctcaacctcagcgacaatgacgttaattacaacatcaatcgggtttacgtagatgcgcaggaccctaactatggcagtcaaccttcgagggtcatgatagaagattacggcaccgaactgaccccagcctttctcgtgggtaaagcgggattggaattcaccattcccacgccggcagaccggcgtggcggtgatacttatcgagtacttgtgggaagtaatatcgttgcgatcgaggatgacgtgccggtgacaggcgacattactggtcatattccaactgcaacgattcttgagcggtcaggttcgatagacgtgagatataacctggctgatcggtctggcaacacgactacgttgtctattccaaactacgtacaagtgagtctgaacgaagcgcccgtgtttggtcccgtcagtgtgttggaagagccattggttgataaagcagaggcccgtaacggcgcaacggtgcggttggaaagcctgaccggccatttgcagaacgacactctggtcgtgttatgggggactattgagatctatcgtcaatctgttggcatgcccgttttcccaattgacatccctgcacgttttgcagctattgcggcaggcgggaatttctatacggcggatatcaaagtcatgattgagcgccaaggcagccccacttacaacgcagctttggtgcaagtggatgtcgacctgcgtgagcccggtgggcaaaaccctggcgaaggccctgtagacacaaacttggcacagcccgttctgctcggtgggggccccgaccccaaacccgataaccgcctctccgagaaagatcgcaacttcgatgccaccgtcactttcaccctaccaccggggctggaagtgggtgatttcattgactatgtctatgggggggatgtcgttgggacttacccggtaaccggggcggaagcgcccgattttccggtgccttttaccgtgccgtgggccactatcgatgccaagggcaatggcaccattgaaactcactgcgttattcgggatgccatcaactataagcattctccgaatcaagatgttgtcgtggagatcttcaacatcggtagcctcacgcctgtgacctttgaaaatgccacggttattacaggcaacccgaacttcacctatgccattaactgtgctcggcagccttggctaggtgtgcctgtcaagattctggatcccgggctcctcttggttggcgacaaagtgatcatcgaggctgtcagatacgcgttcaacgctcctggcgcgcctgtcggtacgcccatagagacctctgaattcgagctcaacagtgagcatgtcaatcttggcttgaccgtcccgctggatttgaaggtctggcttcaagacgtcacaggcaataatggccgaggcatcgtcggtgtgcgttggaggcttctgcgcccctccacgggagaccggggcaggtccgacgaggtgagggcagcctgggatctggttggttcgggaggcaacattcctggctattgtgttccgggtgcgtcgcgcgtcaaaggtacgctttgattgattgtcggggccccaccctctcgcttgagagggtggggttttttattgagttttgtaccttaaggaaagtcctacgctctttgggaactcacgttattagtctctgcaccgtggaaaacggaaacctcttcgatacgggttccgggttcgaactggtacttaattctgaggctacacaacatgatttctcctgcttcccagcgttttcgttattcgcgtttatcatcgatcatcaagctcgtagccgccgcaccgttatgcctgttgagtcaacaggcaatgtcgacaattgtggtggacggaacggtgggcagcggcaaatatgatgtccgcccgggggccgcagccagcgactatctggcccaaaaaggtgcgacgctgactgttcacaagaacgccaacgttaaagaaatacgtgcgacgagcgggtcgaccttgacgttgacaggagccaacgtgagttctgtccatggctcccaggcggctattgcgctcagcaattcaagcgccactatttccgacgcgcgcattaccagccacaccagtggcggcttgaatgtggctcgccaggtgggcacgcccacggggtcctacgcacaagtcgacaatagtgaaatcactggagcgacctatggggccaacgtcacgtcccatagccttctggagttgaacaactctgtgctggtgggccaacgccagcaagggttgaggctcctgggaggggccgcaatcgccactgacagcgaaattaccggtggtaccacgggcgttgtgatgtcccttgaaagtgcaactgcccttgagtcgcctcacctgatactcgacggttcgcgtgtgacgggcctcgatggccccgcgattaatgtactggggccgatcacggctgaaatcgacgtgaccaatggttcgtccctgcagggtcagaacggtaacatgctcgagctgacccagggcggctcggccaacatgcgcgtgcgcttcagcgagttggctggcaatattcaggtgggtgccgacagcgcgttggaccttaacctggaccacgcaattctgacgggtgatgtcatcaacaacggcggcagcgccagcgtcggcctgaataatggctcggtgctcaccggccgcctggaaaacgtcgacacactggcgatcaacagcgacgccacctgggtcatggtcgacgaccagcatgtgggcgatctgctcctggccggcggtaacgtcaagttcggcgacaccggcacgttctacaaattggacgtggacaacctgtcgggtaatggcacgttcgtcatgagcgtggatttcgctaccttgaccggcgacttcctgaatgtcaccggcacgtcctcgggtgaccatcagttgttgatcgccagcaccggtgcagacccgttgtcggaagatcgcttgcatgtcgtgcacaccgaagacggcggcgccaagttcagcctggtgggtgaacgggtggacgtgggtacatactcctacagcctggttgacgacaacgaaggcaaggattggttgctcgatccgggcagcaaggtgatcagcccgagcaccaactccgtgctggccctggccaacgcggcgccgagtgtgttgtacggtgaaatgaccaacttgcgcacccgcatgggtgagctgcgccacagcgatggtcaatcgaccgggttgtggagccgcgcctatggcaacaaatttgaagtgaacaacagcgataaaggcatgcagtacaaccagacccagcgtggtttcaccctgggtgccgatgtgccgttgaccggcggtgatggccaatggctggcgggcttcatggccggtcacagcacctcggacctggacctgagccgcggcagcaaggccaccgtcgacagctactacgtgggcggctatgcaacctggctggatgcagagagcggcttgtactttgacggtgtgctcaagttcaaccgcttgcacaacgagtcagacgttgccatgagcgacggcaagaaagccaagggcaactacacgcaaaatgcggtcacggcttcggctgaagtggggcgtaatatcaagctggatgacggttacttcgtcgagccatacggccaattggccacggcgatcatccagcgccagagctatgagctggacaacggcctgcaagccgaaggcgcacgtacggcctcggtggtgggtaagctgggcgtgaccgccgggcgtgacatccagttggacagcggcagcgtgttgcagccgtacctgcgtacggcggtggcccatgagttcaaccagagcaacaaggtgtccgtcaatggcaacagcttcaacaacgacctgtcgggttcgcgggttgagatggcggccggtatcgccatggcggtgtcgaagaattggaaggtgcatgccgatgtggaacgtagcatgggcaagagcattgaccagccttggggggtgaatgtggggttgcgttacgatttttaaggatgtgaacgtctgacgtgtaacccactaaaaagccccggatcgcaagatccggggctttttattgagttggcaccgggggcgagctaaaacaccaccaaacacacggaatcgtaccgtaccgtctggcaggcgggacgcgcatatgtgcagggggattggtttttcctcgcgcgcttgctgttcggtaacggtgtggaagtcgaccgggaccagcagatcgttgcagaacagctcaatgaaatcaccttcaagctggcctgcataggcgcgcaagatgcaaatcaagcctgcgctaccgtggccctccagtaattgttggtacacgccatcggagaaccctaccgccggcgtggtcaaaccgggaatgtaaggcgctagctgcgagacaggagggaggttgctcagggcgggttccatgatcaggacctcgtagtaggacgcggcaccgcgacgggagggagcatcagggattgaacgcagggtggagggcggatgaatagctgtgagaatggacagtgccgacgagtggtatggtgcactgaggctgcctgaatcggtgcccccaaacttgcgtcgagcagatatattcgcgctttcctacgagtcgatgcggccgcgtgactcttctgccgggctggctgcaagcactgaaaatgcgaataagcgctgattagtagcgaataaagcgcaaacaggttcatcggagagataaacctgtttgcgttacttctggcttaagttgccctggatatcaaagttgaacgataaacaccgtattggcattgtagttgctgactaaggcatatgacccatcgggggcaatggcgatactttttgggtggacgaaccccgtgatggttctgatgacttcctctttgtcggtgtcaataattgccactgagttagcgctgttcatcgctacataggctaacgggcgtgtagggtgaaaagctataccgaacgcaccgggaagattaggcacagtgttgcttattaagctagtgcgtgtgtcgacgactttcaggttgcccccttggtccggaatataaattttttgtccatgagggctgtacgccagtcggtaaataccagaaaaacctgaaagtgtcgatacctgattgttggtggcagtgtcgataatgcccatcgcaccatagcctgcacagtatagacgtgtgccctgcggagccagcgtaaagtccattgggtaataggcgttgcccgtgtagattacgctgctgtccgatgtgtcaataacttgtaatgagctgtaggaataactgccgtagtaaaggcgcgagccgtcaagattaaatgttagggcgccaaatccataggggttaacgccagtaattttattgatgattttattgtcgcttgtatcgattatttgaatttcgccaatgtagtatccactgacgtataggcgtgatccgtctggatgaagcgccaatccatttgtgtaagtgttagcgggcagaataatggtgtccgaaaggctgaatgtcgtcaggtcaatcacggataccgtgctggtattgtagttcgcaacataagccacggtcccctctgcattaatgacgatgcgatccgggccgccgcctacgttgatgctgtctacaacgcccggttgcttcctgattctgtaacttgcaggcaccaaccgttgcgctgtcgcccgcccgccgccatccagcgatacatacgccttgaggtccagcgggctgccatcggcgagtcttctcaggtaactggccggaataggcgtaaggatgcgctcggcggcaaactcggcgggcgtcagcggggtaccgttgcgcaacacttgattcactgtgccctcggcgtcaatccacaccgcttgcgggttctcagggtcgtagcgcaaaaacggccaggcatcgatccgaacatcatgtgccttggtgacgtcaatcaccccgccattggtctcggcctgcggcacactcaccaagtcccaatactgcgcctccagcgcctcgatctcgagcgtcagttccctggacggttcacgcttgtggtcacggatcacctcgtagaacacccggcaactttgcgccaggttggcgcccacaaacacgttgggcacggtgaaatcgacatagtctccaccgggcgcaggtatgccaggcttgatgccgatatccggtgtgccgagctccggtttgccgatgacgtacacctttatgtcatcgcttgccagcatcgggcgataacgtacgcgcacggtcaccacgcccgactgcagcacatgcgcagggttcaggcggctcagggtcgacgtgatctgcgtgctttcgagcacttcggggacgggcaggtcgagggccgcgccgacgcggatcggcagggcctcggaaagcatgtcacgctgccccggttttaccacggtgtagtacaagctttgggtgccattgaggttggcggtgacgtagagccgagcaaccacgaagggcaggtcgacaccgagccagttttcgtcgatctcgaattccatccgcggggcgctaccgccaggggcactgccttcggcgtacaggtacaccgtggcgcccaaggtgaaggcgggatgagccttgaccgtgacattcaggttgccgcggttcttgtccgggtcgaacacatggtccggtggcactgcttcgcgtgtgatgggcgctggcaggatggctcgcaggcctcccacgtacaggttcagccgacgtgacggtggcccgccgttgacggtgtagtgcagcgagagcgagccgccttccaactgggcgatttcgccattgggcccgttgggcagctctaggactatatcgttctggccggcgcgggccgtgtgctcggcatagtaggaccgaccattggcgtaggtgccgttgagcaccagcaaaacgcgagcgttggcagggtagccggtaagggccctgatgaacaccgtcactgggtcggtggctgcgggcaggtttccacctacggcctcgagcacgataggtggcgccaggccggcctcgacgggggtaccggtgatatccaccgacctgtcgagggagttgcgtggcaatgcgttgaggcgaagccgttgataggtcaattggacgcgcccatcgatcaacggcacgatatcggcgtagggccagcggatgcgctgggcgcgagtggtggagtcaatagggtggtcgtaaaaggtggtaatcaactggctgccttcagtgcgcccggagactttcaggcgtagtacgtcaccgagttcatagccctggcggttcacctcaaccacaatggttgcatcgttgccgtcaaggtcatcagcatcgagcagatcgttttggcctggccgctcgatggattctgcgatgtaaggggccggtaaaagcggttctgcacccgtgttgcgccgtacctcgatgacttgaggtggggaaaatccttgggagtggttgccgacctcgtccaccacttcgtattcgcacacgtgcacgccgtcacccaccttatcccaagtgccggtgttgacgttgatgatgatcggggcttcgcccgccgcctcgaattcagtcacggggtgtttgacaacgacccccccgaggctcaggcgaatttcatcacgaaccttgcgatgattgaccctggggaggtttgtgttaaccgggtaatagccgatggatacggggatggggtttatggagttttccgacgtgacgccgaagtcgattacatcctgaggaaatacgggcttgggcaggttctcgttttgcggggtgctggccaccgggttacgcccacctgggaactcgatatcgaccttgatattgaagggtttggtttggtcgctgcctccaccgacgtgggtcacaaaggcctgcagtgtattgccggcctcacggataaagcgttcgctggccacatgcaggacaatttgcaggccctggcgggcctcatcctcggttacggtatgaaagtcaacgcgaacaccatttaatttcagctcgatgaagtccctgtcaacctgctcaagataaggcagcaggatacaggtcacgcctttgtcactgacctccagcgccgctcggttaaagccaccatcgaagccgaccaccggattgctcagagtgggcaggtacaggggcaagtccgcgaagggagtattgcgaaaggactgtgacgtcaagatggcgtcgtcgggttgggcaatggtgaagccttcagggcgcaaagaggcgggctgaacggaaatgggtgagcgatcggggtgctgggtatcctggtcgatagtcatgaagaaggtcctgtcagagccgttgaggggcgtgcccgaactggttgggctgagcatcactcggttgattcaacgctgtgacgagggcgagagatagctgtgagaattgacagtgccgacgaatggtaggggcctggggcgacccaagccaaagcaagatcaggcctgccgattccaatgcctgaataacggctccgccagaaacaacacaaacaacaagcgcatcacctgcatcgccgtcaccaacggcaccgacaattgcagggtctctgccgtcaggctcatctcggcgatgccaccgggcatcatgcccagcgtcagtgagcgcaggtccaggtgggtcagcgcactcaaccctaccgctgccaacgtggcgagcgccatggtcaaggccgtgccaatcaaggtgcggcccatgaacgccggtgcgctgcggaagaactgccgattgaagtggcagcccaaaccgctgccgatcagccattggccgatctggctgccgccgtcgggcaggccaatgtgtaaatcccaggtcacgctggcgatggcactcaccagcaatggcccgaacaaccagggattgggttggcgcaaacgctgccagccccaggcaaccagcgcacctatcggaaacagcagggccagccacgtccagtccacaggcgccgggtgaaactgcggtgtaccgccacccagcaaatacttgaagatcgccggcacacacaacaccaccaccagcacacgcaggctttgtcctgccgccacccgactaagtattgcgccgttgcgggcgccgaggttgaccatctccccggagccgcccggcatactggagaaaaacgccgtggcgcggtcttcaccgctgcggcgcatcaaccacacgccgaccacgctcgacaaactggtcaccagcgccccgaagaagatcaggccgaagtggctcatcacttgctcgatcaccagcggggtgaagtgcaagccaatgccgatgcccactacccattggccgcatttgcgcccgccgggaatctccgccaattgccagggcgtgaggcagcgcaccaggatgatcgccagcaacgagccgaccatatacggcaaaggccagccgactaggctggccaggtaaccgccggccaggccgaccagcggtgttccccaccaatgtttgaaggtgacctcagacatcggccacggcacgacgctgcagggctcgtttgcgatagatgcgaatcagcgggaacatcagcatcagcgctgtcagtacccatacgccaaaagtgatcgggctcgaccagaggatgtccagtgcaccgttggaaatcgacagtgcacggcgcaagttctgttccatcaggccgccgaggataaagcccaacaacactggcgaaagcgggaaatccagcttgcgcaggatgtagccgaagataccgatgccgaccatcaggaacagatcgaaggtggtggcgtgcaccgcatacacgccaatggcggtaatgatcgcgatcaccggcaccagcgcccagttcggcacagcgaggatgcgggtgaagatgcggatcatcgggatattgaggatcaccagcatgatgttggcgataaacaacgacgcgatcaggccccagacgatgtccggttgctgttgaaacagcagcggccccggggtgatgttgtacagcgacagggcgccgatcatcaccgccgtggtgcccgaacctggaacgccgagcgtcagcatcggcaccaatgcgccacaggcggatgccccgatggcggtttccggtgccgccaagccgcgcatatcgccctggccgaacttgccgctggcaccggccaggcgtttttcggtcatgtaggcaacggcggacgccagggttgcaccggcgcccggcaatacacccatgatgaaaccgagcaagccgcagcggacgttaaccacgaacaccgcacccgcttccttcaggttgaacatcatgcgcccggtggccttgactgcttcctgaccacggtgggttttttccagcagcaacaggatctcgctgatggaaaacaggcccagcaccagcaccacaaactgaatgccatcggtaaggtggatgttgtcgccggtaaaacggtacacgccgctgttggcatcgatgccgactgccgagaggaacaacccgatcagcgccgccacgaaagtcttcaacggcttgtcaccggccatgccgccgaggcagacaatcgcgaacaccatcagtacaaaatactctgccggcccgaaggcaatcgcccatttggccaacagcggggcaaacagcaccatgccgcaggtggcaataaatgcaccgatgaaagagctccacgccgacaacgacagcgccacacctgccagacctttgcgggccatcgggtaaccgtcaagggtggtcatcacggtggaggcttctccagggatgttgagcaggattgaactgatacggccgccgtattcgcaacccaggtacaccgccgcaagcaggatcaatgccgactccggtggcaggcccagggcaaatgcgatggggatcagcagcgctacgccgttgatggggcccaggcccggcagcaggccgaccacggtgccgatcagggtgccgcacaatgcggtcaccaggttataggggctcagcgcgacgccgaaaccctggcccaaatagccaaaggtatccatatcagttctccagaacgtcgagcaggccgaggggcaacggcacatccatggctttatcgaacagcaggtacaggccgatagccatcaggccgacgattaccacgctggcgacccagcgaccgccatacaggcgcgccattggaatgccgatcaacatgctgctgaggatgaagcccagggattcgaaggtggcggcgaagatgagcaacagtgcgacgcacatgccgattttgatcagggtctcgcggtccagcgccggttcttcttcggtgtgcttggtgggttgcgggcgaaagagcatgtagatcagcgccaggctcatcaacccgagcatcagcagaggataggcgcgtgggccgaccggctcatatgaaaatgccgcctgatacggccaggccatcagggccaggccggcgcaggccagcaacagcacggcggcgaaaatgcgttgtaagagcatagaaaactccaaggcccctctagtaggagcgagcttgctcgcgaaaaacttcaacgataacgcgtgctgtctggacgcacgtggatgtcctcggattcttcgccagcaagctcgctcctacaggggcattacacgaaagacgggcgtttactggatcaggccgaactctttggccagtaccttgtagtcagccacctgtttcttcacataggtgtccagctccgggccggtcatggcgaacgggaacagctcgcgctggtcacgcagcttggcgaattcgtcggaggccagcagcttgtcgaatgcctctttccaccatgcgtagtcggcatcgctgacctttggcccgaggtagaagccccgtaccaccggccagacgatgtcgtagccttgctccttggcggtcgggatgtctttcatttccggctcgtccaggcgcttctcggcgaacacggccaacaggcgcatgtccccgctgaggatgtgcggcatcgagtcggagatgtcagtactgcccacttggatgtgcccaccgagcagggccgtggcgatttcaccgccgccctcgagggccacgtaacgcagttcacgcgggttgatcccggcggccttggcgatcagcgcggtttgcatccagtcctggctgcctactgtgccgccggagccgatcaccacgctgcccggatcttttttcaaggcttttaccaggtcgtcgagggtcttgtagggcgagtcgctttttactgcgatggcaccgtagctggtgcctacggcagccagccagcgcacgttggtttcatcgaaacggccgaacttgccttgggccaggttcaatagcgagccgctggaccaggccaccagggtgccggcgtccgcagggcgctgggcgaccacggcgttgtaggccaccgcgcccacgccgccgggcatgtaggtcacgcgcatcggcttgctcagcagcttttcattgaccaacgcgctttgtgccagcttgcaggtcaggtcaaaaccaccgccgggggaggctggggcgatgcattcagggcgcttgggttcgtcggcagccagcagttggccggcgaacagcatgcagccggcggcaagggcaactctacgtagtgaagaggtcatgggatttctccgttattgttcttattttgacgaaaacgcttcgaggcgtttttcgggtgctacgaatcaggtagctcggcaggcatagaccaccgtggctggatgctaaagggcgaagctttcactaacctttcaattgtctttcaatgttttcgggcttcacagggcaggttgcgcctgtaaactcgccggccagcgggtcaataaaaagccgcgccgaccacccctcatgaggtagaaatccatgcgtgtccttctggttgaagaccatttgcaactcgccgaaagtgtcgcccaagcgctcaagggcatgggtttgacggtcgacgtgctgcacgatggcgtggccgcggacctggccttgggcagtgaggagtacgcggcggtaatcctcgacgtgggcctgccgcgcatggatggtttcgaggtactggcgcgcctgcgggcccgtggcaaaaacctgccggtgctgatgctgacggcgcgcagcgatgtgaaagaccgagtgcatggcctgaacctgggcgccgacgactacctcgccaagccgtttgagctgacggagctggaagcacgggtcaaggcgctgctgcggcgcagcgtgctgggcggggagcgccagcaggcgtgcggggtgctggtgtacgacctcgacacccggcgcttcacggttgggggcgagttgatgaccttgacctcccgcgagcaagccgtgctcgaagctcttatcgcccggccgggccgcgtgatgagcaaggaacagttggcctcccaggtattcggcctcgatgaggaagccagccccgacgccatcgaaatctacgtgcaccgcctgcgcaagaagctcgacggccagcccatcgccatcgtgacgttccgcggccttggctacttgttggaagcccgcgatgcataagcccagcagcctgcgctggcgcctgctgtgcaacctggcgctgctgctggtgttgttgatgctcgccagcggcatgagtgcctactggaacggccgcgaagccgccgacaccgcctatgaccgcaccttgctggcctcggcgcgcaccattgccgccggcttgacccaggtcgacggcacccttagcgcgaatgtgccatacgtggccttggacaccttcgcctacgacagcgcagggcgtatttattaccaggtcaatgacatcgaccagaagctgatttccggttacgaaaacctgcccggcccgccgcccggcacaccacgcaccgacgattacccggcattggcacgcttctacaacgctgtgtaccagggccagcctgtacgggtggtgagcctgctcaaggccgtctccgaaccgaacatgaatggcatggcggaaatccgcgtcgccgaaaccgacgaagcacgggtcgccatggcccgcagcttgatggccgacacactgttgcgcctgggcatgctcgccatcggtgcactgctgctggtgtggttcgccgtgagcgcggcattgcgcccgttggaacgcctgcgcaccgcggtggaagagcgccagcccgatgacctgcggccgctgccgctggtggaagtccaggatgaattcggcccgttggtgcgttccctcaaccactttaccgaacgcctgcgcgggcagttcgagcgccaggcacagtttattgccgatgcagcccatgagctgcgcacgccgctggcggcgctcaaggcccgcctggagttgggcctgcgcgccgaagaaccggccacctggcgcagcaccctggaaagtgccgcccaaggcaccgaccgcctgacgcacctggctaaccagttgttgtccctggcccgcattgaaaacggtgcccgggccattgccgagggcggtgcgcaattgctcgatctcagccagttggcccgcgagctgggcatggccatggcgccactggcccatgcgcggggagtggccttggcgctggaggcggacgagcccatatggctgcgcggcgaaccgacgctgttgaacgagttgctgagcaacctggtggataacgccctggcccacacaccgcctggcggcaatgtgattctgcgggtgacggcaccggcggtgctggaggtcgaagatgatggcccgggcatcccgctggatgagcgggaccgggtattcgagcgtttttaccgacgcagccagcagggcatggggtctggcttgggactggcgattgtcggggagatctgccgcgcacacctggcgcagatcagcctgcatgatggtgagttggctgggctgaaagtccgcgtgagttttattgcgggttgatcagtaaaacattgagcgcgcttcatccagttcagcgcgtgacttttcgctgtagagatcaagctgcagcttttgcatcgccggcacgctggtaatgtcgactttcgccagcggatggtcggtgttgtggtggcagtagagtacggcgatttgcaccagatcgacatagtcgagcctggcagagtcgcgttccaggttcaggtactgccccggcagttttgccagcatttccggaaagtcccagccgcccaacagtttgtcgcccagcaacgggtgaatgctctcgatgacgtggttgaggctgaccgggtccgagagcagttcgtaatggtcttcggcgtaggtgaggatcggtagcacgccgatctggtgcaccaagccaccaagggccgcctggtccgccttgaggtggctatgcttgcggcacaaggcatagctgacgccggctacttccaggctgcgacaccacacatcacgcattttctgtgcaaccacttcggagcgggcgtgaaagatctgctccatcaccaggccgatggccaggttgctgctgtagttggtgccgagccgcgtgatggcggtgtgcaggtcggtgacttcctggctggcccgcaacagcgggctattgaccactttgatcaggcgcgccgatagagcggtgtcgcgactgatcaccttgctcaagtggctgatgctgatctccgggtcttcggcggcctggcgaatcctcagggccacctccggcagtgtcggcagaaccaggtcatcgttgtcgatggccatcaccaaagcctgttggactttttccgccagcttgttcattcatgctctctagggtgctgcaaaaaggtacggcaattaacgctggatctcgcgatcacggtccagttggtagggcaggtcgagcatgcgcaagccagggccttccaaggtgcccaagcgcacgtcgccattgtcggcagcttcggcttgcagcacggcgagaagttcaatcgactggtccgcttttgccgcgatgacgacttcgccgatcgcgctgttgtggctgggtgaaaacaatggcgtgcctggctcgggtagatcggccgcctccaggctcaggcaatacaggcgtcgcttgagtttgcccaggtactgcatgcgcgcgacgatttcctggccggtgtagcagccttttttgaagctcacgccacccacggcctgcaggttgagcatctgcgggatgaacagctcgcgagtctgcggcatcacctggccgatacccgcgcggatctggccgagcagccaggcattcaagtcagcctgtggcagctgcgcggccagttggctgcgcacgacgtcggcttgctctacgggcacccagagttcggcacggttaggggaaacgcgtatggcgatgagcgaatcggtgcgtactacgttgtcggtctcggccggcagtgccaggccaagggcggccagggaagcgtctgcgttcgccaggccaaagcgcgcccaggcggcgctttcgtcggtgagtttggatttggagaacaccgcgtatttcttcaggtcggccagctgtggttcgagcagctcggtggccatggccatcagcacgccgtcgccttgcaacaggatgcgaaagctggactgcatacggcctttttgcgtacagcgtgcgcccaggctggcctgggtgtcactcaggtaattgaggttgcaggtcagttggccctgcaggaacttggcagcatcggagccgcggacggcaagcacgccttcgtgggtcagtgagcagaaaaacgcagagtcggccatgggtcatcgcacatcaaaaagtcatgggtgcatcatagaggggcgcccggcaaatggatagtttccgtatgggcgaccaaagccgagtgtcccggtgtcgccggggctgtatactggcgctctaattgaggagggctccatggtcgaagatgtagaaatcaatcgtctcttctggcacagccgtcgtggcatgcttgagctggatgtgttgttggtgccgttcaccaaagaagtgtacgcgacgcttgataaagtcgatcgcgatctctacgtcaggctgctcgaatgcgaagaccaggatatgttcggctggttcatggagcgctccgaatctgaagatccggaactgcagcgcatggttcgcaagattctggaccgtgtccagcccaagtaatcgcttcgaatgccgctgggaggcctcacggctgttgctggcggcgtatctgcttgcccagctgattgcgctgggtagcctgctggtgctgaacctgccttattcaagccttggcatcctgctatgcctggctcactgcacctgggtgctgccgcgccatatcctgctcactcaccgttcgtcgattcttggcctgcgccgtgacgaagatggctggcaattatggaacgccgcgcgcggttggcacgcagtgcaactgcgtcccgacagcctcgcgttgccgctgatcgttgtgttgcgctaccgggtgcagggtgagcggcgagtgcgttcgatctgtgtgccgcaggacgcacaggctgccgatgtacaccggcgcctgcgggtacgcctgaagttcagccgccgtaggtggttggcaccaggatagtgtcgcgggcttcgggcagcatctgcgggtagtcaagggtgtaatgcaggccccggctttccttgcgctccatggccgagcgaatcatcagctctgccacttgggccaggttgcgcaattcgatcaggtcacggctgaccttgtagttgctgtagaactcgtcaatttcatccagcagcaagcgtacccggtgttgtgcacgttgcaggcgcttgttggtgcgcacgatccccacgtagtcccacatgaagcgccgtagctcgtcccagttgtgggcgatgatcacgtcttcgtccgaatcggtgacctggctggcgtcccagcggggcagggcggccggcaccgggatgcgcggcagttgttcaaggatgtcctgcgccgctgagcgtgcgtacacgaagcactcgagcagtgagttgctggccatgcggttggcgccgtgcaggccggtgaagctggtttcgccgatggcgtacaggccgggcacgtcagtgcggccatgctggtcgaccatcacgccgccgcaggtgtagtgcgccgcgggtaccaccgggatcgggcctttggtgatgtcgatgttgaaggtcaggcagcgttcgtagaccgtcgggaagtgggtcttgatgaaggcttcgggcttgtggctgatgtccaggtatacgcagtcgatacccaggcgcttcatttcatggtcgatagcgcgggcgacaatatcgcgcggcgccagctcggcgcgagggtcgaagcgctgcatgaagcgttcgccattgggcagcttcaggtgcgcgccttcgccacgcagggcttcggtaatcaggaaactcttggcctgggggtgatacaggcaggtggggtggaactggttgaattccaggttggccacccggcatcccgagcgccaggccatggcaatgccgtcgccacaggcgccgtcggggttgctggtatagaggtagaccttggccgcgccgcccgaggccaaaatagtgaagcgtgcgccgtaggtatcgacttcgccgctggcacggttgagtacgtaggcgcccaggcagcgctcgcccgccaggcccaggcgtttttcggtgatcaggtcgacggcgacgcgttgttcaagcaattggatattggggcgttggcgggcctgctcgagcagcgtcttgaaaatggccgcgccggtggcgtcggcagcatgaatgattcgacgatgactgtggccgccttcccgggtcaggtggaactcaaagccaccgtcgtcgctgccggcatgttcatcgcgtgtgaacggcacaccctggtcgatcagccattggatggcttcccggctgtgctcgacggtgaagcgcaccgcctcttcatggcacaggccgccgccggcattgagggtatcctcaacatgggattgcaccgtgtcggtatcatccagcaccgcggcgacgccgccttgggcccagaatgtcgagccgttggccaggtcgcctttgctcaagacggcgatacgcaggtggctcggcagggtcagcgcaaggctcaagccggccgcgccgctgccgattaccaggacatcgtgttggaactgttggctcattgaatggattccgcaaaaagcgatccgaaggagcggcgcaaacaggacgcctggatcggcgaatcaaaggggcacacgggccactagtatatagagggggggagcggcacaatagccacgcacacgtggcattgtgagattatgctgcgcagctttgggaaatggccggttggcgaggcgggaactttttgcatgggtcccgactcaatagcaggttgcccgaaagctgggaaaacgttgagtttattggcccgtcgggagcattggacgcgtcacgaaaccggcgacaagattattcgcgcagccggcgccgcccgggctgcgtttttcgtgtgtgccaaatcagtgcatgccggaaacttgcttgaagggggagaacttttgcgaaaagcccgagtctatgtttgcaagcctgatcgtttagttatgcaagcctccttcgagtacaacgaggagtgttcatgctaacccaggaagaggatcagcagctggtcgagcgcgtacaacgcggcgacaagcgagcatttgatctgctagtgctgaaataccagcacaaaattctcgggttgatcgtgcggtttgtgcacgacacccatgaagcgcaggacgttgcacaggaagcctttatcaaggcgtaccgtgcactgggaaatttccgcggtgatagtgcgttttatacgtggctctaccgcatcgccattaacacggcgaagaactatctggtgtctcgcggccgccgcccaccagacagtgatgtcagttcagaagatgcagaattttacgatggtgatcacggcctcaaagatctcgagtcgccggagcgtgcattgctgcgcgacgagattgaaggcaccgtccatcgcacaattcagcaactgccagaagatttgcgtacggcgttaactttacgtgaatttgatggtctgagttacgaagacattgcgagcgtcatgcaatgtccggtggggactgtaaggtcacggattttccgggcccgggaagccatcgacaaagccttgcaacctttgttgcaggaaaactaaagacagcggcgacagccaagagaggaaccgccatgagtcgtgatgccctgcaggaatcgctgtccgcagtgatggataacgaagcggatgaactggaacttcgtcgggtgctcaatgcatttgatgatgccgaaacccgtgatacctggtctcgttaccaagtcgctcgggcggtgatgcacaaggatcttctaatccctcgtctggatattgctgcggccgtttctgctgcgcttgctgatgaagccgttccggcaaaagctgcacggggtccatggcgtagcctgggtcgcctggcagtagctgcttcggtcaccgtcgctgtgctcgctggtgttcgcctgtacaaccaggacgagattgctggcaacgagttggcccaacagactcagcaaccggtcatggccggtccgcaagtcaaaggtccggctgtactggcaggctacaaggaaagctccgataccaccggccctatggctaatggtgtgcttcaagggcaatccggttggcaggaccagcgtcttccaggctacctgcgtcaacatgcgcaggaatcggcttcgaaaggcactgatagcgctctgccatacgctcgcgcagcaagccaggaaaaccgctgatccgctaaggagccctatgcgcgccataccgctccttacgctttggctcagtagttggtttgcactatccgcccatgccgatgaagcccaagactggctgaatcgacttgggcgtgcagagcagcagcaaagctttgaaggcacgtttgtctacgaacgcaatggtagtttttctacccatgacatctggcatcgcgtccaggatggccatgtacgtgagcgcttgttgcagctcgatggcgctccccaggaagcccttagggtagacggtcgcacacaatgcgtcagcggtgcgctggttgctggcctggcgagttcttctgatgcacctacgcgtgcactcgatccacaaaaactcactcaattctacgaattggccgttgtcggtaaatctcgcgtagccggtcgtaatgcggtgatcgtgtcgatcagcccgcgtgatcaatatcgctatggtgttgaattgcacctggatcgtgaaaccgcgttgccgctcaaatccttgctgctcaatgatcaggggcagttgttggagcgctttcagtatacgcgcctggatgcccgcgccgttccgtccgaccaggacttgcagcctggccgcgagtgctcgcctgtcgctgtttcctcttctaaagcctccgacatgcctgccacccaggtgtggcatctggattggctgccgcctggcttccaacagatcagtgctgtcacgcgcaaagatacccaaaccaaagccaccgtcgatagcttgatgtatgacgatgggctcgcgcgtttttccgtgtttctggagtcagcaaaaggtgctgatgtgaatgaaacccgtgctcagcttggaccaaccgtggccgtatcccgacgtttgaatacggtggaaggtgaaatgatggtgacggtggtgggcgaaatccctatcggcactgctgagcgtatcgctttatcggtgcgtagtggaaaggctgctgccaagccatgaaattgttaatcctgcgttcatgctgatctttcaatctgtgcccatctttggttgggtgctgagcgtatgaaatctctggatcagcattttcacttgcaaaaactccctatgttttttataggtcagggtttaatggccctggccttgttttgttcgcgggacaaaagtgtcggtcgcagtctccggcatgtattgaaccctgtcgcttaaccctgctcgtcgtaacgggagctgtatgtcgataccacgtttgaagtcttacctatccatagtcgccacggtgctggtgctgggtcaggccttgcctgcgcaagcagtcgaactgcctgatttcacccaattggtggagcaggcctcgcctgcggtggtgaacatcagtaccacgcaaaaactgccggatcgcaaagtatcgaaccagcagatgccggatctggaaggcttgccgcccatgctgcgcgagttcttcgagcgcggcatgccgcaaccacgcgcccctcgtggcggcggtggtcagcgcgaagcccagtcgctgggttctggcttcatcatctcgcccgacggctatatcctcaccaacaatcacgtgattgccgatgccgacgagattctcgtacgcctggctgatcgcagtgaactcaaggccaagctgatcggtaccgacccacgctccgacgtggcgctgctgaaaatcgatggcaaggacttgccggtcctcaaactcggtaaatcccaggacttgaaagccggccaatgggtggtagccatcggttcaccgttcggcttcgaccatactgttacccagggcattgtcagtgccatcggtcgcagcctgccgaatgaaaactatgtaccgttcatccagaccgacgtgccgatcaacccgggcaattccggtggtccgttgttcaacctggctggcgaagtcgtggggatcaactcgcagatctacacgcgctccggtggtttcatgggcgtttccttcgcaatcccgatcgacgtggccatggacgtttccaaccagttgaagagcggtggcaaggtcagccgaggttggttgggtgtggtcatccaggaagtgaacaaggatctggctgagtccttcggcctcgacaagccggccggtgcgctggttgcacagattcaggacaatggccctgctgccaagggcgggctgaaagtcggcgacgtgatcctgagcatgaatggccagccgattgtcatgtcggccgacctgcctcatctggtcggcgcgctcaaggctggcggcaaagccaagctggaagtgatccgtgatggcaagcgccagaacgttgagctgaccgtcggcgccatcccggaagaaggtgcgaccctggatgccctgggcaatgccaagccaggcgccgagcgcagcagcaaccgcctgggtattgccgtggttgagctgaccgccgagcagaagaaaaccttcgacctgcagagcggtgtcgtgatcaaggaagtccaggacggcccggccgccttgatcggcctgcagcctggcgacgtcatcacccatctgaacaaccaggcgatcgactccaccaaggagttcaccgacatcgccaaggcgttgccgaagaatcgttcggtgtcgatgcgcgtcctgcgtcaaggtcgagccagcttcatcaccttcaagctggcggagtaatccactagcccacaaaaagccaagctcgctcaggctacgactagtgacgngcgcattttttgtgggtgatgggtttagctcatcatgcccttgaccaagcgctcctgttcgatcagctcacgctgacgggcatcgatgcgcgaggacagtgggaaattattgccggcgcggcgcttggcaaagtccaactgctggatggcttgctggaaatcacccaccagggcgaagtattcggcacgagcctggtgcaggccgatgatgttgccggacaagccgcgggtctcggcgacctgataccacacgtccggatcgtccgggcgggacttgagcagcccatccagcgctttctccgcatcagcggtgcggttctgcttaagcaacaagtccacccgcacctgattcagcggatagttgctggggtactgggtgagcatgcggtcggtacgttgctgtgcgtccggcatgcggttgctggtgatgtccaactcgatctgcgccaggttgtaggtaatgtcgttgggcgccttggccagcagcggtgccaggctctcccgtgcttccttgagttgagtgcccttgatctgtgcgatggccaggccatatcgcgctacatcgttcttggggttctcgtccaactgggcctggaagcgcttggccgcaaggcctggcgtgtcttcgtacttcaattgcacccgtgcgcgaatcaactgatagcgcaggctgtcttccttgccgccgggtttggcctgctcggcgcggttgcgggtatcggcgatccgcgattcagtcaccgggtgagtcagcaggaactccggtggcttggcatcgaagcggtattggcgcatcaggcgttcgaacatggtgggcatggagcgtgggtcgtagccggctttctccaggttgaggatgccgatacggtcggcctcttgttcgttctgccgggagaatcggcgttgttcctggatcgctgcggcttgtgagccggcaatcgcggcgatacccgcgtcgcctgcacccgcggcggcggcgatgataccgccgagcagggcggccatcatcggcagctgcatgcgcgactgcgcttcgacgccccgggcgaagtggcgctgggacaggtgcgccagttcgtgggccagtaccgacgcgtattcaccttcggtctgggcattgaggaacaagccgccgttgaccccgacgatcccgccaggtgctgcaaaagcattgagttgcgggctgttgatcaggatgaattccaggcgccggtcgttgacctggctggtctctaccagcttgtacacgctggtttcgacgtaatccttgagttgtgggtcattgagctgagagacctggccgcgcaggtaggccagccaggcgcggcccagttggtattcctgttggggcgagacaatggcagaactggcgtcgccaagtgacggcagctcgtcagcgaaggccggggaggccagcaggcaggccagcgtcagcagggtagggcgcaaaaaagtcatgcacaaagcctttcgacaaagagcttactgtagccggacactgagcttgggaccagatattctaagcagcccaaatgtttgcctggagtaacaccatgaccgacgctgcagcctttgacgccgaactcgatgcctgcggcctcaattgcccgttgcccttgctcaaggccaagttggaactcaatcgtatggccagcggcgccgtgctcaaggtgactgccacggatgcaggctcacagcgtgatttcaggaccttcgccaggctggcgggccatacgctgctccgcgaagaagaggccgctggtgtgtaccattattggttgcgcaaggcctgatagccttgcacgcgcaagatcaggccttgttcagcgcctgcgccgcggccaggaccgcatccacatgccccggtactttcacgccccgccattcctgacgcagcacgccttcgctgtcgatcaggaaggtgctgcgatccacgcccaggtattccttgccgtacagcttcttcagcttgatcacatcgaacagctggcaaaccgcctcgtctttatcgctgatcagctcgaaggggaattgctgcttgcccttgaagttctcgtgggacttcacgctgtcacgcgacacaccaaacacctcggtgttggcggccttgaacgctgcgtactggtcacgaaaaccctggccttcggtggtgcagcccggggtgctgtccttcgggtagaagtagatcaccacttgcttgcccttgagggccgcgaggctgaaagtctggccgctggtggcctgggcttcgaaatcggccacggctttgtcgatggctaccggcatgggtgtttccttacattgggttctgtgggcgccatggctcgatcaaggcgtcgagattcagggcatcggcgaagtccagaaactggtcgcgcaaccaactgatctgcacgccggccggcagggtcacggtgaacgtggcgttgagcatggtgccgccggtctgtggcgcctggtaggtgtcgcaggtcaggttttccagctcgacgttgtggtcgatgaagaactggcacaactcgttgacgatgtccgaacggtaggccgagctgacgtacgccacataaggcagggcctgcgggcgattttccagggcggcgctgcgcaccacattgacggtgaagtcgtgtttcttggccaggcccggcaggccggtttccagacgcgccaaggcgtcccaggagccggagatctgcaataccagcgcactgcactcgccgtggcgggtcaggcgcgaggtcacgacggcgcagcggttttcatggctggcgcggcacaggacgttggtcagctccatggggttggcgccgagggcactgataacaaggaattgttcgcgaactgtgggggtggacatgcagccttcctaaagcgatgagcggtcgataccgtgtggccgtatcgatcaaaggatgaagggtagcgaaaaccgtcgccaagggctaggaggtggcgttttcattgtgtgatcggtcggcttgcggcagtgctttggcccaatgatggcattgcccgacgtttagttggtccagaacgcatcctcacgcggtacttcgcttgtacaagcatcttggcgccagtaccattacggctctctttttccggcaggagcggttgcatgattgcgggcagtatggtggcactggtcacacccatggatgcacaaggtcgtctcgactgggatagcctgggcaaactggtggacttccacctgcaagagggcaccaacgccatcgtggcggtcggcaccacaggtgaatcggccacccttgatgtggaagagcacatccaggtgatcgagttcgtggtcaagcgcgtcgcgggccgtatccacgtgattgcgggaacgggcgcgaactccacgcgtgaagcgatcgagctgacccgcaacgccaagaaagccggcgccgacgcttgcctgctggtcacgccgtattacaacaagccgacccaggaaggcctgtaccagcacttcaagaccatcgccgaagcggtcgacatcccgcagatcctctataacgtaccgggtcgcaccgcgtgcgatatgaaggccgagaccgtaatccgcctgtccaccgtgccgaacatcatcggcatcaaggaagccaccggcgacctgcagcgcgccaaggacatcctggccggcgtgagcagcgacttcctggtgtattccggtgacgacgccaccgctgtcgaattgatcctgctgggcggcaagggcaacatttccgtgaccgccaacgtggccccgcgtgccatgagcgacatgtgcgcggccgccatcgccggcgatgccgcgacggcccgtgcgatccacgagaagctgatgccgctcaacaagacactgtttatcgaatccaatcctattcccgtgaaatgggcgctgactgagatgggcctgatgccggacggtatccgtctgccgctcacccggctcagcgaagcctgtcacgaaccgctgcgacaggccctgcgccagtccggcgtcctggtttaattgaggaagcactacgcatgaagcgattggccggactttccgcacttgccttgattatctccagcaccagtggctgcggttgggtatggggcccggaaggctacttccgtgaccgcggcagcgattacctggaagcgcaagcaaccaaaccgatgcaactgccgcctgacgtcaatgtcgccaagcgccttgacccgttgctgccgattccgcgcaacgtagccgacgacaccgtcaagggcgagtacgtggtaccgcgtccacagccgattaccgcagtggcggatgccagcgactacagcctgcagaaaagcggcgacaaccgctggatcgtggcccagcgcccacccgccgaagtctggccagtggcggtgcagttcttccaggacaacggttttcgcatcgaccagcaacgcccgcagaccggtgagttcaccacggcgtggcagcaaggtcgcgagctgtccgcgaacatggcccagcgcctgttggctggcggtgtagccgccgacagcgaagcccgtgtgcgggtacgcatcgagccaggcgtgcagcgcaataccagtgaagtctatgtggtcagcgccgagcgtcctgccggcagcactgccaatgttgatttcaccccgcgttcggtcaacaccggcgtcgatgccgcgctggtcgacgagatgctcgccagcatgagccgtatctccgagaagggcggttccgtttccctgctcgccgcccgtgactacgacacgcctaaccgcgtcagcctcaccgaagacggcagcggtaacgtggtgctgaacttgggtgaagacctcgaccgtgcctgggccagtgttggccgtgcattggagcagggcccttggcgcgttgaagacatcaaccgcagcctgggcctgtactacatcaacgtggctgaaaaggcggagaagaaagacgacgagccaggtttcttcggcaaactgttcggcagcacgccgaccaaggaagaggtcgaaacccgcgccgagcgttaccaggttcgtttgagcaaggttggcgaaagcgtgcaagtcaccgtcgagaagaacatcaacaccgtcgcgccggctgaaacagcgcgcaaagtgttgggcgtgattcaagacaacctgggctgatccggtgcgttttgccgttctcggcagcggtagccaagggaacggtacgctggtcgcccatgacgacacgtatgtgctggtcgattgtggtttctccctgcgggaaaccgagcggcgcctgctgcgcctgggggttcaccccgcgcagctgagcgcaattgtggtgacccacgaacatgccgaccatgtgcatggcgtgggtttgctgtctcggcgctacaatcttccggtgtacttgagtcgtggcacgctgcgcgggatgcgcaaacccattgaacccgcaggcttcctggctggtggcgagcaactgcaagtcggtgccctgagcatcgatgtcattgcggtcgctcacgatgccctggagccgacgcagtacgtattcagtggcggtcagcggcgtttcggcgtgctgaccgacctgggttcctactgcgccaaggtgctggacggttaccgggacctcgatgccttgatgatcgaatccaatcactgccgagacctgctggcgcgcggtcattacccctacttcctcaagcaaagggtgggcggcgagctgggacatctgaacaaccaccaggcggcgtacctggtatatgagttgggctggcaagacctgcaacacctggtcctggcccatctgagcagcaagaacaacctgccgacgcttgcccggcaatgctttgtcgacacccttgggtgcgacccggactggctgcaactggccgatcaagattcagggctcgactggcgacacatcgcctagcccaccttactcaaagcggagcccatcatggaaaaacgtgaagaactctaccgcggcaaagccaagtcggtgtacaagaccgacgacgccaaccgcctgatcctgctgtttcgcaacgacacctctgcgttcgacggcaagcgcatcgaacagcttgatcgcaaaggcatggtgaacaacaagttcaacgccttcatcatgcagaaactcgaagcggccggcatcccgacccaattcgacaaactgctgggcgacaacgagtgcctggtcaagaagctcgacatgatcccggtggaatgcgtcgtacgtaactacgccgccggcagcctggtaaagcgcctgggcgtggaagagggccttaagctcaacccctacaccttcgaactgttcctgaaggacgacgccaagggcgacccgttcatcaacgaatcccacgtcgtggccttcggctggggtaccgctgaacaactggcgcgcatgaaggagttgtcccttaaggtcaacgatgtgctgaccaagctgttcgacgacgcaggcctgttgctggtggatttcaagctggaattcggcgtgttccacgacggctccatcgtcctgggcgacgaattcagcccagacggctgccgcctgtgggacaaggacaccaagaagaagatggacaaagaccgcttccgccagggcctaggtgatgtgatcgaagcctacgaagaagtcgccaatcgtctgggcgtaccgctgtaatcgacgcaagcatctgatagcacggaaaaaaatcacctttggggtttgcttccgcgaaacacactgttatgatgcgcgccgttggagagatgccagagtggccgaatgggacggattcgaaatccgttgtaccttcaccggtacctagggttcgaatccctatctctccgccattatttataaacagaaacccccaataacttaaaggttgttgggggtttttgtttttgtagcagaaatgctcaggtgaattctgctacggtcgtgattacctgatgacaatgcgggtcaatcatgaattttgaaaaagtgctcacgcatttgcaggctaaccttccaagtcttttggcagtgtacgtctttggcagccaggcgacgggcgaggcaaatgccgacagcgatcttgacttggctgtgctgattgagggaagcattgacccactgcaactgtggcgcctatgcggggaattagcggatatcgtcaaggtccccgtcgatttgctggacttacgcgcagcctcgacggtcatgcaataccaagtcataacgacagggcgccgcctctggagcaaggacagtcaggcgggtatctttgagagctacatactcagcgagaaaactgcattggattgcgccagggcagagctgctagtcgacattcaaaaggatggaacggtatatggccgatgatgtactcatcaacaaggctgccagtattgagcgttgcgttgctcgtgctcgggaggagtacgaaaaggatccagccagttttgccactgacttcacccgtcaagatgcggccattctcaatattcagcgtgcctgcgaggcggctctggacatggggcaacatctgattcgtcgtgagcgcctcggtgtcccccaaagtgctcgtgacgtgtttgagctgctggcgcagggaggatgggtgaatccttccttactgactaacctgaaaaacatggtcggtttccgcaatatcgcggtgcatgagtatcagacgcttcagttgcctattgccgttgcgatcatcaccaaacatttgggcgatttcctggcattcagtgcacatgtcttgactaaggacgcaggccagtgagccgattcaaatggcccgcggtaaaatcaaggctacaggtcgtctagagaaaccttcactcgctgagcagacgcctggcgctcacgtacggtcgctatcaacgcttcatccttttttgccgggcgctttttgtccgattcttttaccgtttcccttggtcttttcttcgcctcttgctcggttacgtattcacctgtgaccgcatcgcgatatctcgttggcatatcagcatccttgacagtatgtcgccacggcggcgacctttttgaggctagcttgcacgtttgtgcacacaagcttcctcgccggaattctggttaccaagcttttccgaaacaggtgcttacgttgtgccggttcgacagttttccagcagggttgcgttgactggggcaggacgctaacctttcgccgtcgccctcatggcgaccggttttgacagactgatttacaggtgtacgacctccatgcgattacagcgtttctgctgtgacgtcgttttatggcggctgtgcgtggggcatcttcgggtgcgccgggtcctgtataccggtctgtcaacccgcgcatagctgccacctgattctgtttgacagcgggatgtggcagctcccattgcatacaggagctacacaatgagcaatctcgattctgactccgaattttcccctcggaaaatcttccatgtaggtgcagatgtcggcaccgaagaagccctcaccaacgccaccgaaatcctttcatccgccctgcaaaccgcctatcaatgcgccgaagatcctgacagcacgcagtcgcccgtgatcatggccctggctcaattgatcgaaaacgcgcaaatgctggtggatgccgtcctcgagcgtgatttccccacggccaaataagtacctgctccctgaaacgaaaaaagcctgctgaactcaatgctcagcaggcttttttgcgcatctaacccggtcaggcaggctgcgccaccaggctattgctgaccttgcgccccaataccagcacggtcgcaaacccgaaccccaccaacaccgtggccaggctcaacaacaccgagctgcccatctggtcgacgatgcgcccgccaaagaacgagcccagggcaatgatcacctgaaacagcgccacaaacagtggcatgccgcgttcgacatccttgggggccacgacaaacatccagatgctggcgcaagccgggaaggcgccgaaggcgaaaccccagagtgcgatcagcatcgaggcgcctgtcaggccggtggcgaagtaggggaacagtgcggtgctggtaccgatcatcaacgcaaccagcagcagggtgtgacgtacgctgcggttggcggcgaaaccggcaaagatattgcccattaccccggccacaccgtagagcagcagcaatgaaccaattgtcgggccgtcaaagccggagctgtgtttgaagaagggggcgacataggtatacgcagcaaagtgcgccaggccgatcagcaatacagcgatcaagccgactcgcgcctgtgggttgataaacaacgcgggcaagtcacgaatctcaatggccttttccggcgtcagtcgcggtagcaggaagatctgcgcgagcagcaccggaatgcccaccaacgcagtaaccaggaaggtcatgcgccagcccatcagtccactgagccaggtgccgacgggcacgcccagtacggtggcgagcgttacgcccatcatgatgatcgaggtggctttcgcaaccccaacgcctttgggcgccagccgcccgctgagggcaatggccgtggcccagaagccgccgatgctgatgccgagcaatacacggccgaacagcagcaggctgaaatcgttagctaaggccaccaccgagttggcgatgatcatcaccagtgtcaggccgatcagcaggtagcgacggtccatggcaccaatgctgaccgacagaaacggcgcggcgagggcggccatgatgccgggcaatgtgaccatcaacccggcgtgaccggcactgatgcccaggtcgctggcgacgtcgttgagtacgcccaccggcagaaattcactggtcaccagggcgaaggcacccacggcgaccgaaagaatcgccagccactgctgtttgacgctttgttgattatgttcgggaagcccgctaggggcctggctcgcgcttggcatgggattgggttccgggaggaatgtcgcctgaagccaggcgaggagggaatttggagcgattataggaatcagtggcggcaatcgttcaggcgctcgtttcgatagtaatcatcagtgctatcgatgtgagatttaaagagccttgaatctgccgcacaaacgaaaaagcccgtcgctgggtcaactccgggcttttccgggtatgacgatgtttaaggcgcagcggtggagtcttattttagctagccaacgcattcagtacatggactgggtcattatggatagctttcaacaatgcctttgctggtccggtaggctcacgacgaccctgctcccagttccgtaacgtgccaagttgcacatcaatcagcgctgcgaatttagcctgggttagccctgtcgccttacggatctctttgactcgcattgaatcaacatggaactcacgagaaggttcgcgttctccgcgcaggatctcgttcatctcttgaacgctttccatcagttcatcaaaaaatctgctcatagctatctccagtgctcaatcgcagccttcagtgacttgcgctctacggcagtcaagtcctgctgttcatttttgggatagatcatcagtaaaacaatctgtgatgccgagacgaaatggtaatagatcacccgcgccccgcctcgtttgccatggcctttggctgctactcgtatcttgcgaactccacccgtaccctcaatcacatcgccagcagaagggttgactaccagcacgttctgaagagccatgtaggcatcctcgtcgatcaattctttaacgcgacgggtgaagactgacgtctctatgaaaaccatcgctaatgtacgccattggcttagttggctgcaatcctagccgtgtgtgcttcgacgtgcattcagtgagttgtaactgctttttgacacgcaggatgtggtcaattatacatcggccaaccgccccaaaagactctcaataaacaccccctccgcccggctcatcttctgctcccggttccacaacagatgaatatccacatccgcaatcccctcatccggcggcaaccgccacagcagcccgttcttcacatcgtccgccaccacatgaatgggcaaacaccccaagccaaacccggcaatgaccaaacgccgcacttcttccaggctggaagatgacgccacgatccgtccgctgaacccttgctgatcacgaaaaatcgtcagtggcgagagcatcccgccaatctggtcgctggtaaaactcacgaagttttccgactgcaaatccccctcggccagacctttgcgcccaaacaatgggtgatgttttccgcaaaagaacgcataacgctgacgcagaaacagatgctgttccaggcgcggttgcggccggcgattgaggctgagccccagggtcgcggttttttccagtagggcggcgacgatgtcggaactgcgcatcacttcgacttccagatcaacccgcggatggtcgcgatgaaaacccgcgagaaagtcatcgaaggtgtctgaattaatccggctgatcatcagcaagcgcaccttgccgatcacttcatcaccgggcttttgcagggcgttgctcatctgcgacacctggccatacatctcaccggcaatcgcgaagatctgttcacccgcctcggtgagcacgaagcgcgggccacggcgcacgatgagctggcagtcgagttgctcttccagacgcttgagcgcctggctgatggccggttgcgtcaggtgcaggcgcgcggcggcgcggctgatgctcagttcctggccgatcacgcggaaggtgcgcagcaggttccagtccaggcggtcgttgagcagcggatgaatatcgcgacgggattcgggcatggcatcgctcgataataagcaggatttataatcaagataataaatagaaaattgactaatcatagcctggagccgaaaaatcgggcttaacaagcgccaccagagcgcaccggttcgaccttctcctgccaaaaaaataaccaaaggagccagccccatgaagccttccgcttcgccgcagcctcgccgtgccgcggccgccgcttttatcggcaccatgatcgagtggtacgacttttacatctatgccaccgctgcggcgctggtgttcggtcagctgtttttcccctccgacgataaactgttcagcaccatggctgcgtttggcactttcgccgtgggctttttcgcccggccattgggcggcattgtgttcggccatatcggcgaccgcatcggccgcaagaaatccctggtgattaccctggtcatgatgggcgtggtcacggtgtgcattggcctgttgccgacctatgcacagatcggtgctgccgcgccggtgctgctgatactgctgcgggtagtgcagggcattgcggtcggtggcgagtggggcggggcggtgttgatggctggcgagcatgcgccaaaggggcgacgtaacttctttgcgtccttcgcgcagttgggtagcccggcgggtttgattctttccctgctggcgttcagtgcggtgacccgtttgcccgaagaagacctgctcagttggggctggcgtctgccatttctggccagcgccttgttgttggtcgttggcctggcgattcgcttgggtgtgaacgagtcgccggagttcctcgaagacaaagccctggcggaaaaagcgcgggcgatcaagaaggaccaggcccccgtgctggaagtgctgaaaaccgcttggcgcccactgttgttgtgtattggcgccaatacgttggggattgccggcgtgtatttcaccaacaccttcatgattgcctacagcactcaacaattgggcctaccgcgctcgttgattctggaatgcctgttcttcgtcgccattatccagttctgcgttcagccgctggccgcctgggtggcggagaaggtcggcgctacgcggtttctgtgcgccatgtgcgtgctggcaatggcctcgccttacccgatgttcgtattggtcagcagcggccaggcgccgttgatcatcctcggcattgccctggcggtggtgtgcatggcgtcgttctatgcagtcatcgcaggttttgtcagcggcttgtttgaaacccgcgtgcgctacaccgcgatctccctggcttatcaggtatgcggtgcgttggccggtggcctgacacccttgatcggaacctggctggcccatcagtaccaaggtcaatggtggccgatggcagtgttttacagcgtgatcgcggcggtctcgttgatgtgcgtactggccttgtcccgccgccatgccacggcccaccgcttggaaatggcacacagttgaggaagtcagcaatgttgaagattaatggcgagcgcctgtgggccagcctgatggccatggccgagatcggcgcgaccgaacgcggtggcagctgccgcctggcattgagcgccgaagacaaggccggtcgcgagctgttcagtcactggtgtaaagccgctggcctgacgttgagcgtggatgccatcggcaacctgttcgctcgtcgcgcgggtaccgacaatgacgccgacccggtaatgatcggcagccatctcgatacccagcccgaaggcgggcgcttcgatggcgtgtacggcgtattggccggcctggaggtgatccgcagcctcgacgaccacggcatccagacgcgcaagcccctggaaattgcggtgtggaccaacgaagaaggtgcgcgtttcaccccggcgatgctgggctcggcggtcttcaccggtgccctcgcgctggacaaggcgctggcgaccaccgacggtgatggcgtcagcgtggacgaggcgttgcgcgccaccggttataacggtgagcgtgcattgggtggggcggtggatgcgtatttcgaagcgcatatcgagcaaggcccgatcctggaagacaacgccaaaaccatcggcgtggtcaccggcggccaggcgattcgttggctcgatgtgcgggtcgaaggcatggctgcccatgcgggcaccacgccgatggcgttgcgcaaagatgcgttgtatggcgccgcaaaaatgatccaggccctggaaaacctcgctgccgattttgccccgcaaggcctgaccaccgtgggtgagttgagcatcgccaagtcgtcgcgcaacaccattcccggtgtgctcgactttactgtcgatctgcgccatcaccgcgacaccgatatcgacgccatggagcagcaagtgcgcgcacgcctgcaggcgattgccgacaaccgtggcctcagcgtgaccatcacaccgcactggatcagcccggcgacgccgttcgacgcgcaatgcgtggcgtgtgtgcaagcgtcggtggacgctctgggctacagccagcagaccatcatcagcggcgctggccacgatgccatccatctggcgcgctattgcccgaccgcgatgatcttcatcccctgcgtcggtggcctgagccacaacgaagccgaagacgtcttgcctgaagacgtgcgccagggcaccgatgtattgcttaacgccgtgttgaaacgcgccggtcaagttcagtaaggaatattcttatgcgtacattctttcaccccgaacaactgctgcatcacccacgcagctactactctcgtggccagatgcgcacgccacaggaggttcccgagcgtgcgcgcaaccttctgctggctgcgcgaaccctgggtttcgatatccagcagccggtcgactacggcatggcgccgctgttcgccgtacacggcgcggcatacctgggttttcttcaagaggctcaccagcgctggaaggaaatccccgaagactggggcgacgaagtcatgtccaacatcttcgtacgcgagcccaacgccctgcgcggcattcttgcccaggcggcacggtacctggccgatggcagttgcccgatcggtgaactgacctggcgttcggcgtattggtcagcccaaagcgcggttgccgctgcccatgccatcctcgatggcgcgcctgccgcctacgccttgtgccgcccacctggtcatcacgcccgcttcgatgcagcgggtggcttctgttacatcaataatgcggcggtggctgcgcaggctttgcgccaaaacttccagcgcgtcgcggtgctcgataccgacatgcaccacggccaaggcattcaggagattttctaccaacgcaatgatgtgctttacgcgtcgatccatggcgatccgactaacttctatccaggagtggccggctttgccgaggaaaaaggcgatggcgcaggcttaggattcaacctcaacctgcccatgcctcatggtgccagcgaagcgctgtttttcgaaaagctggaactggccgtggcagcggtgaaggacttttcggcggatgtgctggtgttgtcactgggtttcgatatttacgagctggacccgcaaagcaaggtcgcggtgacgcgggaaggctttgcgcggctggggcagtgcattcgagggctggggttgccgtgcttgatcgtgcaggagggggggtatcacctggagacgctggacagtaatgcgcaggcgtttttcagtgcgccagcggcttgggagaagctatcaggcgattaagcgctaaaagcctgccgatcagttttcagcaggcttttcatctatcaatgagcagtcgttcccctcaccctggaacagcgccgtgtagttttgcccgccataaaatccccccactatcgacaccgtttcgcaatcaggcctcaccctgaacgcgatgatggtgctgcaacgatagtgcgtgatgcgcaagcctgtaagcaggtcgtcacggcgcgtgccacgcaaggggaacagggcgaggctttcacagtggctgacgagattgtcgataaagcgcgtcgctaccaagggggagccggcatcgcagatgtaatcctcaagggcatcgagttgcgtcaggacttcaggcgaaaaaaccaccgagtagctcacgcgttcccgatgcctttgcgctgacgcccggctgccatatgctcgcgaacctgttctgcagataacccgagctcaggctgtgcctcaagagcggtcgctgccgggaggacttcgtccctcagccaatcttccatggcacggtcacgtgccagcagcacccgcaatccgtcgcgaatcacttcgctttcgctggcatattcgccggcagccaccttggctttgaccagggccgccatttcaaggggcaaggtgatgctcatttgctgagttgagcgcattgggatgtccgccagaagtgagtaggattcaatcctacttgaccattggcgcgatgcaagaagcaactgatcaatgccgatctccggcgtctcgtcgtccatccagaaggggtaggtttgcatggggtgccgcgtctccagttgtgtgggtcaggctgcaagtattgacccgttttggcgatcgcgtggccgtggatggccgataagctgctgaaatgtatgacttgatatctgtaacaggattatctcgataaagccgccccggctcgcatggcatcccatcggcccccatacgataatgctcgtcacctcgaccactttggcccgcctcccgtgatcatcaatttcgacctcaacgacctccaagccttccgcgccgtggtagacaagggcagttttcgcggcgccgccgaggccatacgtatctcgcagccggccctcagccggcgtatcgagaagctagaatccgccctcgatgtaaagctgttcgagcgcaccacgcgccgggtcagcctgaccatggtcggccgtgcattcttgccccaggtggagcgcatgctcgatgacctcgacatcgccctgatgggcatcagtaatgtcgcgtcgacgcgcatgggcaatgtcaccatcgcctgtgtgccatccaccgcgtattacttcatgccccacgtcatctccgaattccacaagctgtatccgaagattcgcctgcgggtgctggatgccagtgctggtgaggtgagcaatgcggtggccagtggcgaagcggattttggtgtgagtttcagcggcagtctggccgatgaagtggagttcgagctattgctgcaggagcgttatgtgctcgcctgttgtcgtgaccatccgttggccgcacgtgagagcgtgacgtggaccgaagcctacgaacacgactacatcaccgtggacaaaacctcgggcaatcgtttcctgctcgaccaggccctgcgtggcgtgcgcgtgaaaaaaccgagtatctgcgagactcaccacgtgacgacgatgatcgggctggtggaggcggggttgggcgtggcgatggtgccgtcgattgcgatgccggcgcacacccacccgattctggtgagtgtgcccctggtagagccgcaggtgatgcgcaacgtaggcttgatcaaacgccgcggacggacattgccgccagcggcgctggagttggagcgattggtgcgggagatgccgtttcggtcagcgtgacaccgagtccagtccggtggactgcaccaccggctgagcttgcggcgaggccatgaactgcagcagcgccttggcctcgtcggggtgttcggcgttgaccggaatgcccgccgcaaagcgtgtcaccgactgcacgttttccggaatcttgccgacaaacgtgacacccttgaccggcaacaattcagccacctgttgcaagccgacttcgtagtcacccctggccacctgttcgcccacgggtacccgctcgatcatggtgcccttggccggcatgccgagtttcttgaacagctccttctcgacatacacaccgctggcactgtccgaatacgccacggatttagccttgctcagcacggccttgagttcggcatcggtagtgatcgcaggtttcgccgcgccttctttcaccaccagcccaatccgcgagtccgccagttccacgcgggacgcggggtcgaccttgccctgtttgatcagctcgtccagtgcgtagccgaccatgatcaccacatcggcatgttcgccacgagccaggcggttgggaatcgcttccggcgccttgcccaacgacgggccgaggatggtgtcgagggtgtcaccgctttgcttggcgtattgcgggccgagcaacttgtaggcagcggtgaagccaccagaggtcattaccttgagttcttcggcctgggccgccagcgccagggcgccaagggcgaatgccgccagggttttgagtagagtcctcatcaaacggccccctgcatgacctgcccgcgggtgttagcccggcgatacagcgccagggtcgagcacagggcgcacagcgcggcaaacatcatccagtaggccggcgaggccttgtcttcggtgatgtgaataaaccaggtggaaatcgctggcgtgaagccaccgaagaccgcggttgccaggctgtaggccagggagaaacccgccacgcgcacttccaccggcatgatttcggtcagtgccggaatcatcgcgccgttgtacatgccgtaaaggaaggagaaccacagcagggtttccagcatatgggcgaagctcggtgcattcactacgtaggacaacgcagggtaagcagtgagaacggtcagcaccgtcatggcgatcaataccggcttgcggccaaatcggtcgctcaaggtgccgccgatcggtagccagacaaagttcgacacggccaccagcaaggttaccagcaaggcatcggaggtactcaattgcagcacggtcttgccgaaggttggcgcgtatacggtgatcaggtagaacgccgtggtcgtcatcgccaccatgagcatgccgccgatcaccacggtccagttcttcaccagggtcgccatcacttcacgcatggtcgggcgatgcttgcggttggcgaactcttcggtctcctccagattgcgacgcagcacaaagataaacggaatgatcacgcaaccgacggcaaacggaatacgccagccccaatcggccaccaccgccggttccatccaaacgttcaggccatagccgagggcggcagcgaccacgatggaaatctgttggctgcccgactgccagctggtgtagaaacccttgcgacccgggggggccatttcggataggtacaccgacacaccacccagttccgcgccggccgagaagccttgcagcaggcggcccagcagcaccaacagcggcgcccacaggccaatggtgtgataacccggtaccagcacaatcaacagcgtaccgctggccatgatcgacaaggtcacgatcaagcctttgcgacggcccacgtcatcgatataggcacccagaatgattgcgcccagtggacgcatcagaaagcccgcaccgaacacggcgaaggtcatcattaatgacgcaaactcattagcggccgggaagaacgcggcagcgatataggtggcgtagaaaccgaacaggaagaagtcgaactgttcgaggaagttgcccgaagtcacgcggaataccgcaccgattttcgagcgggcagcgtcgggccgggaagggctagtcatggttttgtgtctccagcgttctttttaaagtgcttgtttcgcttaagactggggatagtggctgacacatttagaaatgataagtgacaaatttgaatggattgatgcgcgctggctatcaatcagtgcctccgtcaaaagacctgccttgttctatacttgagccagtgtccaattcttacggatgggaggtggtaatggctgacgaacagaaacggcagaatgagtcggagcgcgaacaaccccggcgacaggaggaggaaaaaccgcagacctggaagcatcccgatgatgggactgagctttccgagcgggaccaggagcgtccgctgaaaccctgagtacccatccagtcaaaaaaattgagagcgacgttgtatgtgtgggggggcgtcaaagtaccttcgctctcatatatgaccgatgcaaagggtatatttatatttcgttttcctcgaagttgaagataaacgctttatttatgtgggtggcaaataattattattttttatattttacgtcgcttttcagggagtgtccctcgaactcgccctcgccatctattttcttacgttcttggttgtttgccgggttaactgcaacaaaattgaaagatattttgatagaagcgtcgttcgaggaaactgataacacattcaccgttcctcctttttcatcggcatcccagctgtttgccctcccgggattgaaccacgcgccgactctggtaactctattgattgcatgctcgccaatagagatatttgtggggaatgtaaaatacaaacctttgaacatgaatcctccttctggaccacctactacaaaagagttcgtgtcggcctcatagataactgagtcagccacccaccgttcagtgtcaccttcgatatcggcttctaagcgacctgtagttgcgcgtttttcgatagtcgtcatgatggagttctcatcagtgtcagtagtatttaacagcctttttcgtgattaatgaataatactaatgtcagtgaaaatctactgtcagatttaacagtaaatcgattcagttgatttgtgggagtcccaccacatcttcgatgtgacgctgtcgcgcagcaaactagggagcttgctcccgtggcggcctgatagccgaggatgttggttttcgtcctgggtacatatccgttgtttaggtaacggccacccggcgtcctgccgggttacccgcggcttcaagcctgcgttcggccagcgtggtttaacggggcgcctgagatcaagatcaagagcgactcgctgcgcatcgcagatacgctggcggcgcttttgcttttctgtaggagcgagcttgctcgcgaaaaacctgagaacgccgcgttctttctggtttcccgcgtcatcgttaacgaccttcgcgggcaagcccgctcccacagttgtacgcgcacgcttcaacgatcaggtcggctataaggccgcctcgctgtgcttttgatcttaggcgccccgttaaaccacgctggccgcaaatcaatgtcggattacgggcacaccgagcctgggcgaggtgccgagtggtggggcaagagtgttttgcttacttctgcgcttttcaaaagtgagccgctgtaaaagcggaaccataagtggccgttacctaagcaacggatatgtactcgccctaacaacccaacaacccggtcacatcgtcgacgtggtgccgtcgcgcagaacctgggccgcctccaaaatatccggcattaagactaaattttaaatatttaaaatcagtagcttacttgaagcttgataagagcagcctcgcctggaagagagcgacgaccgaatttcgcaacaccttcagagacattacccacatcccccaatgcctgcgtcgagaaccgcacccgctttggcggcctagtggccgcgttgtcggcattacgcctgcgccagggtcaggaggcccctcacaccagcaacgaggtcggaaacccggaagccagcaccaggtaagccaccaccgccgccaggcataaaccgacaaatacgcgcagcaaagtcctagcggtggggtgaacgatgaatttgatagcccatagcaaaaaaccgctgagcagtaggcttagggcgaaaatgaccaacacaatggagtacctgcgaccttcaagagctgatttatagtcccaaagcctgcggatgaacagtgcgcacatagacgcagccccgctgcctttctaaactgcggcttgtcttggggaaaggggcaggcgccgatgaatcgcaatgaattacgcaaggccgatatcaacctgatggtggtcttcgaagcgctgatgctcgagcgcaatgtgacgcgggtggccgagaagctgtttcttggccagccgactatcagctcggccctcaatcgcttgcgcaccctgttcaatgacccgctgtttattcgcgtcggacatcgcatggagcccacggcccgcgccgaggaaattatccagcacctgtcgccggccctggattcgctgtcatcggccctgagcctgacccacgattttgacccctccatcagcaccatgacctttcgcatcggcctgtccgatgacgttgagttcggcctgctgccaccgttgctgcgggccttgcgccaggaagcgccccaggtggtgttcgtggtacagcatgtggattactggcgtattcccgacctgctggcttccggcgatatcaccgtcggcatcacccagacccgcggtctgccggcgaatgccaagcgtaagctgttgcggcatatccgcccgtgcctgctgcgcgccgatgcctcggacacgccgctgaccctcgacgaatattgcgcacggccccatgtgctggtgtcccacactgccaacgtggccgggtttgccgatgagtggctggcggaggtgggccgcaagcgccatgtggtgctctcggtgccgcaatacagctcgctgccggcgttgcttgccggcaccgacatgatcgccagcctgccggactacactgctcaggccatggccgccagcgggaacctgttctgcgagccgtttccgttccaaaccccgaccctggacttgtcgatggtctggctcagccatgtcgacactgaccctgcggagcgctggatgcgctcgcggctggaggcattcatgagcgaccgagggcctgctggcgaaatgtaggagcgagcttgctcgcgaaaagcgtcaacgttaactcgggattcctgaatgagcgcggcgcctgcgagttttcgcgagcaagctcgctcctacaaaaggctctgttcctcacacaccctcaccacttgctcacgaaaccaggtattggccctgtcctgcccactggtttcattccattgcatatccagggtgaaacccggaaggccattaggggcttcgcacacaccgaacgccggcgccggtgccagcaatttctgcacgcggcggggcagggtgaggatgaagtcggtgccggcaatcatctttaacgccgcgctgtagctgttggcccgcgcgatcacctggcgcttgcgggcctgccgtgcgagccagccgtcgatcatattggtgtcggaggtccacggcgtggggaatacgtgacgtcgctcaacgtaggattgcaggctgaacgccggctcccggggcgccgagcgttggtcaaacacgcagaccaggtcgtcttcaagcagcatctgtgtcttgaagtctttatgagcgcggtgaaagtgcggaccgaagcagatcaccaggtcgaggcgaccttcacgcaggtcgtcggcggggatatcggtttccagtttttgcacattgacgatcaccggcaggtcggcgcggtcgaagtgcttgagcaggcgcggcaggatcagttgttcgaaatattccggggcgcacacattgaaggtcaccgcctgttgggtcgggtcgaaagcctggccaccggcgtgacacaggttgatgctttccaggatcttctgcacatgcccgtacatggtggtggccttgtacgtagggcgcatgcccgcccgcgtgttgataaacagctcatcctcaaagctggtacgcagcttcttcaggctatagctcacggtggactggctgacgaacagtgtctcggatacatcggtaacgctgctctggtcgtagacggcgatgaacaccatcaggtcctgcatgtcgagttttctgagcaagttactgtttagcatcggtttcgtccgtaaaccctttgtaccgaactcagtacaagactgggcaaaatgttaacggaacgctcgtaccaatagaaagctctgtaggacccttcaatgttatgtgtgggacaaataatgtttgcaatacgacgtcagcggatatgttgcgcgtaatgcttcggatcgaagcggatgacgatcagcagcatcgccaccatcaccgccgtcaatgaccaccaggcccattcgaaactgcccagttggtcgcggatgattccggcgatcagcggcgacaggccggcgatcaggtagccgatgccctgcacaaatgcggtaaggctaccggcgcgccgtgggttgtcgaggtggtcaagagacaggatcaggctcatcggaaacaggccgcctatacccaggccgagcaggcatggccatagcaggctccagtgtccggggctaaggataagcccgcagaaccccaggatgatcagcaccagcagcaccgcgactatcgcgcgtttatcctggcggcggttggcgatggccggcgtgaccaggcccgagatcacttccatggcggtcaagaagcccagcagcaaaccggcattctgttcactccagccctgttcgacgtaatacggcgccagccacgccaacacacaggtgtaggacgccgtgccgaggccgaaaaaaatcgccagcagccaggcgcggcggttgccgaaaaaggaggcctgcgcgcttgaaccggcttggggtaaaggcggcaagactgcgcgctgggcataccagaacaccagagccagcaacgccagtgctgcccagatcgccaagcctatgcgccaactgccggtctgcacttgtacaaacggtgagaacgaggcggccagcgcggcgccacccatgatcgcggtgacatacaggcccatgaataacgagacattagcgctgaaccgcgacttgatcagcgccggcatcagcgcctggatcagcgcaatgccgacacccgctgcgatggcgctgacgatcagctccaatgccgactccaggaacaaccgcgacaaggttgccagcccaatcaccagcaacgacagcacaatgctgcgatgctcgcccaggcgcttggccatgcccatgccaaagaacattgccaggcccatggccatgaccggcaacatggtcagtaaggctgcgctgctgaaactcaacggcacatccaagcggatcgacgacaataacggccccacggctgccattgacgggcgcaggttaagggcgaccagcaccacactgatcatcagccaaacagcggtggtgggttttgcctgaacgttttccatgggcctgccttgagtgaacaagggcgaatcaggccatggatgggaggagcggggcaaatcagaaagtcgcaggggctattgaaaaaatgcaggcccctgacgttgcgcacttcaaatgggaggcggatctccagagttagatagagcggattaaggcttggtcaacgcccaccgctcttggtcgacttcaatcagcgtcggccccgggcgagcagcagcggcctgcaatgccgcacgcagcggttcgacgccatcgatgctttctgccgcgcaccccattgccttggcgatgccgatgaaatccggtgtgtagatgtccacgcccaccggctcgattgcgcggttgagcatgtacttcttgatctcttcataaccctggttattccacaacagcacgatcaccgggatgcgggcttccacggcgctggccagttccggcagggtgaattgcaggccgccatcgccgatcaggcacaccaccggttgcccgttgccgcgccccaaccaggcgccgatagcagcgggcagggcatagccgagggtgccgtagccggtggaggagttgaaccagcggcgtgggtgctcgaggttcagggtgaggttgccgctgtacaccggttgggtggagtcgcctaccagcacggcgtcgggcagcttttccaggacggtatggagcagcagtgtttgtgcgcgggtggcggcatcccaggtgggtgccagttcggcccacaaacgggcgacgcgtgccgcgccccacccggtattgcgtggcgccagtggctggcggttgagttcagtgagcaaggcctcggcggcgattgtcgcgtcggccaccagcgccatctggggcgggtagttgcgtacggtctggtccgggtcgatatcgacccgcagcagcgcgccgggaatctcgaaaccgccggcgaaggtcacgtcgtagtcggtttccgccagttccgtaccgatggccagcaccacatcggcctcggcgaccatggcgcgggtggccgccaggctttgggtcgagccgagcaacaaaggatgtgcggcaggcagcaggcctttggcattgatggtcagggccatgggggcgccgagggtttcggccaggcgggtcagctctggcgctgcatcgatagcaccgccaccggccaggatcagcgggcgcttggcggcggcgagcaagcggctcatctgcctgaccgccgccggtgccgcgccggcgcgagctacgctgaccggtgcactgcccatcagggcgtcggcgttctccaccaacacatccagcgggatctcgatatgcaccgggcgcggtcgaccggcctggaacagcgcaaacgcccgcgccaacacgccgggcagttctgccgccgacatcagggtatgggagaatgccgccacgcctgccaccagcgcgctctggctgggcagctcatgcaacttgccgcgcccgccccccaattggctgcgcgcctgcacactggaaatcaccagcatcgggatcgagtcggcataggcctgccccatggccgtggtgatattggtcatgccggggcccgtgatgataaagcacacgccgggcttgccgctggtacgtgcatagccgtcagccataaagccggcaccctgctcatggcgcggggtgacgtgacggatactggaacgcgccaggccacggtacagctccacggtatgtactccggggatgccgaacacctggtccacgccatagctttccaggaggttgaccaatacttcgccgcaggtcgccatagaggtcgctcttgtgatggattcaaggcgctattggagcggcttgccggtagcggcaacaaccgataaaaagtcatactcgccatgtcctcacgtcatggctgagccgcgatgaaacgtcttccgcccttgcccgcgttgcacactttctgggtcacggcccaatgctgcaacttcacccgtgccgccgagcagctgcacattacccagggggcggtgagccggcagatcgcggggttggaacgccagttgggctatgctttgttcctgcgccaggcgcggggtttgcgcttgaccgaggaaggccgcgagtgggcgttgcgggtgcaacaggtgttcggcttgatcggtgaggccgtggagcagatcggcagccgccgcgaggtgttgcaactcaaggcgtccacctgcgtcatacgctggctgctgccgcgcgtgttgcaatggcagaaggagcgcccggaggtgccggttgaactcaccactaccgtggcctataccgtggactttcgccgcgagcgattcgacgcggcggtgatctacgcacccatcgccgagcaggccgccgaggcacggcatttgttcgacgaacaactgaccccggtgtgcgcgccggcgttgctggcaggcttgcacacgccggctgatctgcagcaacaagtgctgttgcatcccacgagggacgagcgggattggacactgtggttgaaggcggcgggtacgcacttgagtcccctgaaacaggggcctcatttcgaaacactggacttggcgatgacggtggcgtcacagggaaatggcgtggcgatcggtgatcgtgcgttgattggcgaggacttgaaggccgggcgcctggcgatgccgtttgaattgcgggtgccgacgggcatgggctattacctggtgtatccgccggggaaagtgccttctgctggcttgttggccctgatggactggctagtgagccaggcacagcagtcacagcactgaagattcaaatgtgggagggggcttgcccccgatgggcatgggtatctacacaactctgacatgcgaccgtcagtaaccacgatgcgaagcgagccgctcttgatcttgctctgcttttgatctcaggccccccaaatccctgtcggattacgggcacaccgagcctaagcgaggtgccgagtggtggggcaagagcgttttggttacttttgcgcttttcaaaagtgactcgccgtaagggcggaaccaatagcggtcgtcacctaaacaatggatatgtactcgatccaaccgaacatcctggtcggctgtgaggccgccatcgggagcaagccccctcccacatgggccggcggcgtaccagaagttgtgtagatacccatgccccgatagcggtgtgtcagtcacaaataatctgcctgatccactgctatcgggcgcaagccccctcccacattttttaccgcgtggtgtcagtagccaacggtgaagcgctgacgcgagtgtctaggtgtttcaacctcatcaatcatggcgatggcgtagtcggcaaagctgatcgagctgttaccgtcactgctcaccagcagatcatcctggcccagacggaacttaccggtgcgctcggttccatcgaacagggcagagggcgacaggaatgtccaatccagctctttttcctgacgcaacgtttccaggaattcagccccggcactggcttcggccttgtactctgccgggaagcccgggctgtcgatcacccggctgccgtccggtagcagcagcgaacccgcaccgcccaccaccagcaagcgcttgaccccggcctttttcaccgggccgatcacggcgctggcgggcaaggtggcaaagtgtgcggcgctgatcaccacgtcgctgccgctgatggcgtgttgcagggcgtcggcgtccagggcgtcgacctgcttgaccgtgacgcctgggtgtacggcaagcttgtcggtgttgcgggcgatggccgtgacggtatgcccacggcgcagcgcttcttccagcagttggctaccggcacggccggtggctccaatgattgcgatcttgctcatgacgttctccaacagggttaagggtttaaaccaatcaccacttcatttcgcctttggcgactttggcgctcagttccagcgagctttcgtcagcgagggtggggtaacgctttttcatcgccgcgatcagggcggcggaatccttggccttggcggtctcgatgtcgaaggccttgatgtagtcagcggtgaatttcaccgaggccaatgatggcgtgcccaggtaatggcccggaatcaccgtctgcggcttcaggtcttcaatacgcttgagggttgccaaccagtctttatgggattgcgcgccctgggtatcggccatccacaggtggatgttttctgcgaccaccacaccaccgaccacggccttgatcgacggaatccacacaaagctgcgatccggctgcgggccgtcgaggccgatcacctcaagctgttgcccttcaagggtcaggctgtggccttgcagtgcctgcggcacgatggtcttggcgggtttgtcggcgcccattttcgggccccagaattccagcttgccggcgacggtggcgttgatatggtcgaccaccggttgcggcgcaagcaccttggcgtcggggaatgcgctggtgagcgtgtcgaggccgaagtagtagtccgggtcgccatggctgatgtagatggtggtcaagtgcttgccgctggcgcggatcttttgcaccagttgctcggcttggcccttgccgaattgcgcatccaccaggatcgcgtctttggcgccgctgaccagcaccgagctgaccgggaagatcgcggcttcgccggggttgtagacgtcgagtttcagctctgcggcggcggcgtgagcggcgaaggccagggcggcagtggccagggtcaagcgtttgaaggtcgagaacatcgggcagctcctgccatgggtaagggatgcacagagcttagttgcataaaacaccccaaaaaatgcgatgctggaacatagtttgtttctgaaatcgggcaaatcatggatcgtcttcaagcaatgcgcgtgtttgtcaccgtggtggacctgggcagccagtctgccgccgccgaccatctggacctgtcgcgcccggtggtgtcgcgctacctggccgagctggaagattgggtcggcgcgcggctgctgcaccgcaccacacgcaagctcagcctcaccgcagccggcagtgaaaccctgccgcgctgtcggcaattgctggaactgtgtggtgatatgcaggccgccgtcagcgagcccgatgacgcgccccgaggcttgctgcgcctgagtgtgagcacctcgttcggccaggcgcagttgggcgcggccattgccgagtacgtcaaacgctacccgttggtgacggttgatctgcagatgcttgaccgcacggtgaacctggtggatgagcgcatcgacctggcgattcgcaccagtaatgacctggacccgaacctgatcgcccgacgcttgaccgtctgccgctcggtggtctgcgccacaccggcctatctgcgcgagcatccagccccgcagaaagtcgaagacctggcccggcacaattgcctgacccactcttatttcggcaagagcctgtggcatttcgaagaacagggcgaacacgtgtcggtgccggtgcacggcaatatcacggccaacgaggccagcacgttattgcgtatcaccctggccggggcaggggtggcgatgctccccagctaccaggccggtgacttgatccgcagtggtgaactggtgcgcttgctgccagaagccgagccgcggcagatgaacatctacgcggtgtatgcctcgcgcaagcacatgccttcggcgctgcgcagcctgctggatttcctggtgctgcggtttcccgaggagcccgcatgggacaccgggctttgagacgctataaacgcgctgaatggcagccaatcatggcaacttgccctagctgacctatgctttaaacagcgccctgtagatcgggtccggaggtcagtgccatgagtattaaaacccgcaaatacctgacgattttctccctctgcgcattggcgacggcgctttatggcactgccgcctatcgcgtcgagcaaacgcgcatgcaaccagcggctttcgccatcagctgccatcaaggtcaatgcgtgccgcgcaccggcagtttcagcgcactcaggtaggctgcccggccttcaactgctcgcgaaaggccttgggtgaaaacccgactcggcggcgaaacagccgcgagaagttagtcgggtcggaaaaacccagcacctcggacatctcattgatggtcatgctggtgtaggtcaacaaacgcttggcttccagcaactggcggtcatgcatgatctgcaacgccggttgcccacccaactcccgacacgtcccattcaggtgtgagaccgagatgcccagcttgtgggccaagtcttcaatcttggggtgctcgcggtaatgctgctcgatcagttgggtgaagcggcgaaaatactcacgaccccgcggcgcccggggatggcggcgctggatcgcctggcggctgacccacaccagcagcacgctcaccaaggcatgcagcatcatgtcccgggccggctgatcatcggcgtattcgtcctgcaaacgggcaaacaggttattcaaatagtcgctgtccttgcccgccgggtaactgccaagggtttgcaaaccatcggtggtgtcgcccagctgcgcctgcaagtggctgaccagcggcgccgagagggtcacgacataaccttgtacatcttcggaaaaacgaaagccatgcacacacagcggcggcagcacttgcaggctcgactcgttgagggtggtgcgctggccttcgatttccagttgtgcctggcctttgtgcacatacagcaactggcacaggtccgcgtgccggtggggctggatttcccactggtattcccgactgcgccgggaaatggtttcgcagtgcaacaaatcgggcgtcggccactgctggctttccccgtaaagcttgaagaccggaatcgcggttttggtcatggtttcaatccgatactcaggatagtggttcggtaatcgccccgattggcgaaaagtgcaggctttgcggcagttttcaccttcttatgctgctcactcaagtgaaaaatgtcagccacaagtccactgacaactcttttactcgatccgttcgaatgaaggatgaaggcgataaaaataatgaaaactctgaaaacccaagtcgccattatcggtgccggtccgtctggattgctgctcggccaactgctgcataacgctggcattcaaacccttgtcctagagcgccagagcgccgagtacgtgcaaggtcgcatccgtgccggcgtgttggagaatggcatggtcgacctgctgcgcgaggcaggcgtcagccaacgcatggacaccgaagggctggtacatgacggctttgacatagcgctcaatggccgactcatccctatcgacctcaagaccctgaccggcggccagtcggtgatgatctacggccagaccgaagtcacccgcgacctgatgactgctcgtgcagccgccggcgccaccaccctgtacgaagcgtccaatgtgcagccccatgacctcaagggtgagcagccctggctgacgttcgagcatgaaggccaagcctggcgcctggagtgtgactacattgccggttgcgatggattccatggcgtcgcccgccagtcgattccggccgaggcattggaagtgttcgaacgggtctaccccttcggttggctgggcgtgctcgccgacacaccgccggtacacgccgagctggtgtacgccaaacacgcaagggggtttgccttgtgcagcatgcgctcactgacacgtagccgttattacctgcaagtgccgcaggacgaggtcgtggagcaatggtcggatgcacgtttctgggaggagctcaaggcgcggctgcccagcacattggcagagcagttggtcaccggcccgtcgcttgaaaagagcatcgcgccgcttcgcagcttcgtggtggagcccatgcaatacgggcgcctgttcctgctcggcgacgccgcgcatatcgtcccgcccaccggcgccaagggcctgaacctggcggccagcgatgtgagcaccttgttcaggatcctgctcaaggtgtatcgcgaagggcgcctggacttgctggaaaaatactcggcgatctgcctgcgtcgagtgtggaaagccgagcggttttcctggtggatgacctcgatgctgcatcagtttccccaggctgacgctttcagccagcgtattgccgagagcgaactggactatttcattcactccgacgccgggcgcaaaaccatcgcagaaaattacgtcgggcttgcttacgagcctatcgaatagcctgctatcgtatcgagcattcccgcgggcgaccttttcctgcgggccttgctcgaaggttctgccgtgactcacctcaatcagcccgctccaaccgttcccgccgtgcgcagtatccttgctgcgctgatgatggcgatcttccttggtgccctggaccagaccattgtcgcggtgtccatgccggccatttccgcgcagttccacgacgtcaacctgctggcctgggtgatctccggctacatggtggcgatgaccgtggcggtgccgatctacggcaagctcggcgacctgtatgggcgccggccgatgatgctggtcggcatgggcgtgttcaccctggcgtcgctgttctgcgccttggcccagagcatggaacaattggtgctggcgcggattctccagggcatcggtgccggcgggatgatctcggtcagccaggcaatcatcggcgacatcattcccccgcgtgaacgcggccgttaccagggctacttcagcagcatgtacgcggtagccagtgtggccgggccggtgctgggcggttatatgaccgagtacctgtcgtggcgctgggtgtttttgatcaacctgccgctgggcgcaggcgcgtggtacgtggcccatcgcaccctggtggggctgccggtgccgcagcgcaagccgatcattgattatctcggcacggtgctgatgatcatcggcctcaccgccttgttgctgggtatcactgaaatcggccagggccatcattggcgtgacgctcaagtgctggggttgctggcctgcgcgctgctggcgttgagcgtatttgtgtggcacgaacgccgcgcccttgagccattgctgccgatgcacctgttcaccaaccgcagcgcggtgttgtgctggtgcacgatttttatcaccagcttccaggcgatttccctgagcgtgctgacgcccctgcgttaccagaccgtgaccggttccggtgccgacagcgcggccctgcacctgctgccactggcgatgggtttgccgatgggggcgtatttcgccgggcgcatgacctcggtgaccggccgctataaacccatgatcctcagtggcgcattgttgagccccttggccatcctcggcatggcctacagcgcgccgcaggcggtggtgatcaccgctgtattcatgttgctgtgcgggatcgccgcgggcatgcagttccccacctcattggtaggcacgcagaattcggtggaacaacgggacatcggcgtcgccaccagcaccaccaacctgttccgctccctgggcggggccgtcggggtggcgtgcatgtcggcgctgttgctggctctgttgcacgattccagttttgcccacttggccagcggcgcgctggtggccgaaggcagctccggcaacgtcttgctcgacggcctcaacgccgccccgggcgcggcgcaggatgcgttgcgtggggagttggcggtgacgttccggcatttgctgatggtgagtgcggcggtgtcgttgctcgggttggcggcggcgatagcgatgccgaaccgggtgctgcgcggtcgcgaagacaaagcccgctaggtccaaatgaatgtaggagatcaaaatgtgggagggggcaagccccctcccacatttttattgcattccaagtcaggtcaggggctgtagtaacccaccgccaccatgaaatgcccggtcttgcgcacataagcgtgcttgttttcgaccttgccggtcaccgggttcttccagcggtacttgtattccccctggtcctgctcggccatcagcttgaggatcggctcgcccaccggcttgccatccgggtccttgatcttgccgaagtcggtattgaccaggcgcaggttggtgccgtgggccacataacgttgggtatccaggtcgaccacaaacacataaaggtcatcctgcaggaacccgccctgcaaggaattgatcgccttgagtgtgccggtttcgtccttcaccagcgcattcaccgccttgttgcgcagcgctcgcgcctgttccggcgtggcccggggcaggtaatagcccaccgcgaggatgcgttcgcccacccgctgataaaacacgtgcttgtgttcgaccttgccgtcattccagttctgccaacgatagtcagcctgctggatgccctggccttcgggcaccttgagcgcgtccttgaatgactgacgcaaatccggcccgagtatctcggacacgtcgcgaccgagcagtgcagaggaggggccgccactggcgagcagtactccccgggtatcgaccacaaacacatagcggtcctggtcgatgaaatcaccttggcggctgaacgcggcaaaggccttgtcgccttgctggtggtagtacgccaaggccttttccagcagggccttggcggcttgggcgtccgcttcctgagccgggtcggcatgcacctggctgcaacacaacagcagccaggtgattcgaagcagtgtgttcatttacccgtccctcgatcttgttgatgtgccaagagcgtagacggttgccgggaaatcagaagggtttggtcggcaggtatttgccgtccagggtgatgaccgcacgggagccgccgtccgggtcttcgactttcttgatgtccagcttgaaattgatggcgctgatgatgccgtcgccaaactgttcatgcaccaaggctttgagggtagagccgtagacctgcagcatttcgtagaaacggtacatggtcggatcggtcggcacgccgcctgggaaactgccgcgcagaggcacgctttgcagcaggcggctggcgtcctggtcgaggccgagtttgtcgcacacaatctcggcggcgtccttgggcaatggatgctggccgagcagggcggcggtgacgaaggccaggctcaggccggtgccgtcggtgaggtcctgccaggacaggttcttgcgcgccttgaggtcgataatggtgtcggccagggccaggcgtggggtttgggcgaattgggattgcaacatggtgacgtcctcttggtttaagtcaggttcaggcggcgtgggcacaggtggctggatggtcgagcagggagacgaagcgcccggtgcgcccgtccaaagcgtcgatgccgccggtttcgatgtcgtagacccagccatgcaggttcatccggccttgttccagggccagggcgacgctggggtgagtcttgaggttagccaattgggcgattacgttttcgcgcaccaatgcatccaggcgtgcagcgtccgagacgtgctggcgtgaagcgttgatcaccttggccgactcggcatggcgcaaccagttggccacggccggcaaatggtccaggcatgtgcaggtggaaatcgcggtcattgcgccgcagtccgaatgcccgcaaatcacaatgtcgcggaccccgagtaccgccacggcatattcgaccgtggccgacacgccgcccggctccgggccgtaggacggcactatgttgccggcattgcggatgacgaacagatcgccgggctcctgctgggtcaaaagctccgggactacgcggctgtcagagcaggacacaaacaaggtgcctgggttttgcgtggtcgccaggtgtttgaacagatcgctgcgctgggtaaaggcttcaccctggaatttgcgaaagccgtcgatgagatgctgcatggtggttctccttgcgtcgctgatggggcaaggatggaagttttcagttatagcgtccaagaccggtttattatgcttactataagttgtgcctatagttggagcattgtcgatgctgttgcgccatatccgttatttgctggccgtcgccgagcaccgtaacttcacccgtgccgccgaagcgttgcacgtgtcgcagccgaccctgtcgcaacagatcaagcagttggaagagaccctgggggcgccgctgctggaccgctccgggcgcagcatcagcctgaccgatgccgggcaagcctatgtgcgttttgcccggctggccttgcaggacctgcaagccggcacccgcgccattcacgatgtgcaagaccttagccgcgggcatttgcgcctggccatgacaccgacctttaccgcctacttgatcggcccgctgctggcacggttcaatgcgctctatccgggcattaccctgagcatcgaggagttgacccaggaccgtatcgaagcggcactgggcgaagacttgttggatatcggcattggttttactggcgagcatgggccggacatcgagtgcgaggcgttgtttgtcgaagaactgagtgtggtcgtgggtgccactcatccccaactgaaccgcctggactggctcgagcagccgctggtgctactcaatacggggttcgccacccgccgctacatcgatgattactgccgtcagcaaggggttaaaccgtgcatcgccatggaggccaactccatcagtgccattatcgagatcgtgctcagcacgccgctggcaaccatcctgccgcgagcactggcccaggcgcaggcaggcctgcatgacgtggccgtcgacccaccgctgccgcggcgtactgccgcgcttttgagccgcaaaggcgcctaccgcagcgccgcgtgcagggcgttcgttgagttgataatggcgccaagtggcggggcaagcgcgattgccctggtgtaagacaaccaaaatgtgggagggggcttgctcccgatagcggtgtgtcagtcaaaaatattctgactgatccaccgcaatcgggagcaagccccctcccacattttaaccgctgtgtacccgttggatcgtcatcaaggcgtagccaaccactgactgacgatgccctcatacgtaccggtcgcaacgctcaggtgtagccactgatccacataactcttccaggccacatcgtcccgaggcagcaggaaggctttttcactgtattgcattggctgctccgggttgaccgcacacaaaccaggcttgagcttctgctggtagcgcgcctcgctggcgtcggtgatcatcacgtcggcgttgcctgccagcaattggtcaaaaatcgtcacattgtcatgcaggcgaatctgcgttttggccaggtgggcgcgggcaaacacttcgttagtgccgcctgccggctcgatcactcgcacctggggctgattgatctgttcgactgtctggtagcgctgcacgtcggcgcagcgcaccagcgggatcttgccgtcgactccgagggactggctgaagaaggcctttttctggcgctccagcgacacggaaataccgcccacggcgatgtcgcaacgttgggcaaggaagtccggcatcagggttttccaggtcgtaggcacccagttgaccttggcgttgaggctcttggccagggattcggccatggcaatgtcaatgccttcatagctgccgtcgctgcgcaacgaggtgtagggcttgtagtcgccggtggtgcagacggtgagggtgccgcgctgaagtacttcatccaggcgcgaggcggcggtgtcggcctgggcggtgcttgccagggtcgccagtacactgagggctagaggcactttcatgggagtcgaatccttggaggccatgcggggggcggccattatttccagtagaacgccaaggtagcaaggggcggcgaatgtttggctgcattgcaacaaaacgttatagaacctggatctaactcgcgaccaacgcgtgctaaggtgccgggcatctacctcaatgtgatttgcgcatggacggttcttcccctcatctcgcgacattgtccgcgcccggcccggccgatattgaggcgctaccctccgaactggccttctgggccttgtttcactgccgacacgcacgcccacccgatacctttttcctacgttgatctgccccattgatgacgcgctcctgtgcgcatctgcctgacccaagcgtatgagaagcccctatgagtgtttttgcccgcctgcacgaagcccgaaccttccttgagcacaaccccgacatcgagatgttcgagctgtttatcctcgacaacaacggcgtaccccgcggcaagctgctgcaccgcgacgagctgttggcggtgtacgaaagtggtcggccattgcccagcaccatccttggcctgaccattaacggcgatgacgttgagaactccgggctggtgtgggaagtaggcgatatcgattgccgtgcgtacccgatcagcggcagtttgcagcgtatgccctggcgcttgatcccaaccgctgcggtgcaagtcagcatgcaccccaccgaaggcttacccgccaccgtcgccgacccccggcacttgctggccaaggtcatcgatgcgctcaaggccgacggttattacccagtgatggccgcggaactggagttctacctgctcgaccagaagcccgacagcaacggtcgcccgcaaccggcgcgggacgcggacggcaagcgtccacgttcgacccaggtctacggcctgcgcgaactggagcagatcgagccgtttctcgccgacctctatagcgcctgcaaactgcaaggtatcccggcgcgcacggcgatctccgaatacgctccgggccaggttgaaatcaccctcgagcatcgcactgacgcgttgcaggcgatggacgaggcggtgcgttacaaacgcctggtcaagggcgtggcccacaagcatgggatgacggcgtgtttcatggccaagccattcgatgacctggccggcaccggcatgcatatgcatgtcagcctggccgatgcccagggccgtaacctgttcgccagcgaggcggctgatggcacgccgctgttgcgccaggcggtgggcggcatgctcgacaccttgctcgattcgttgctgatgttctgccctaacgccaactcttatcggcgcttccagaccaacagctacgcgccgctggccgccacctggggcgtggacaaccgcaccgtcagcctgcgcgtgcccggcggcccggcccattcccggcatatcgagcatcgcatttgcggggcggatgccaatccttacctggcggccgctgcgattcttgccggcatccaccgcggcatccgcgaacagcgcgaccccggtgccccggtggaaggcaacggctacgcccaggccaaggagttgttgcctaccgattggctgaccaccctgcgtgcccttgaggggtcaagttgggcacgggatgcgttcggcagtgaattcctcggcgtctatctggcggtgaaacgcgaagaataccgccagttcatgggcgaggtgggggagcaggattggcgttggtacctgcaccaggcgtgaccgattcacggtagtgaagctttcgacctttttttcacgttgcggtagttaagctgtggatcaaggtcgttcactaccgttctatccacatgagcccgcgatgtcgccacaacccccatcccccattgagatcgaattcgctgagcgctgtggccgtgagcacgccagggtctgcggtgacccgcgcccacctcggctgctgcagcgcctggcggcgtggcggaatacgcggctggtacgccatgcattgaaggtggccggcgagccggggcttatccttgacctggcgtgtggttcggggcgtttctggccggtgttggctgagcacgtcaaccgggtgatccttgcctcggaccactcccaggccacgctcgatcacgctcgtacccatcatcctggggcgctacttaagcgcgtcaagacattccagggctcggcgttttccattggcctatcggcgaatgcggtggactgcattttctgcctggaattgtttcgtcatgtgcccggcagcgatgtgcgattaatgttgttacgcgagtttcatcgcgtcagccgcgacacggtcattgtcgctgtaggcgcaggaacaccggtgcaggacgaatttcgtcaagcaggcttcaagattctgaattatcaggagttcctgccgggctccagactgtggtgcgtctacgttctgcgtaagagatgataacttccatttgtcggactattcttcgcctattgtcggagttttcatgatgctgtgtgcactacggatgctcgcaagtccctttcgcgatatatactgcgcgccattcttcaagggagagccgtgtggccatcgatattcactggatctgcgacaacgatagcctcggccagcattgcgccgaatggcagcagttgccattcgtcgccctcgacaccgaattcatgcgggtcgacaccttttatcctattgccgggctgatccagatcggtgatggcatccgcgcttacctgatcgatccactgaccatcgataattggcaacccttggccgccttgctggaaaactcaggcgtgatcaaggtggtgcacgcctgcagcgaagacctggaagtactgctgcgcctgaccggcagtctgccggtgccgttgttcgacacccagttggcagcggcttatctcaatcttggtttctccatgggctactcacgcctggtacaggccgtgctggacatcgagctgcccaagggcgaaacccgctccgactggctgcagcgcccattgtccgagacgcaggtcagctacgccgccgaagacgcggtgcacctggccgaggtgtatatccgcctgcgcccgcaactatcggatgacaagtacgcctgggtactggaagacggtgccgaactggtggccaacctgcgtcgtgagatcgacccgtacgaggtctaccgcgatgccaagctggcatggaaactttcccgggcccaactcgccgtgctgcgtgagctatgcgcctggcgcgagcagcaggcccgtgcccgcgacctgccgcgcaaccgcatcattcgcgaacactcgttgtggccgctggccaaatcccagccggataacctggcggcgctgggcaagatcgaagacatgcacccgcgcaccgtgcgccaggacggccagttcctgctggacctgatcaagcgagccggcagcgtgccgatggaccaatggcctcccgccgtcgccgagcctttgccggtggacgcagccacgctgatcaagcaactgcgcgccctgggccagacgttcgccgaacgcctggacatggcgccggaactgatgctgcgcaagaaaaccctcgaagccctggttaaaagcggctaccccgatgggccttatcaattgccagactcgctgcgtggctggcgtcgcgagctgatgggccaagcgctgctcgacagcctggccactgccggagaacagccttgaaacgtatttgctccatctatcgcagcaagaaaaaagacggcatgtacctctatgtgctcaaaagcgacgccctggagcgcgtgcctgaacccttgatggacgcttttggcaaggcgcaccacgccttcgacatggtgctgacgccggagcgcaagctgtcccgcgaagacatcacggtggtgctggaaaacctcgacaagcagggttaccacctgcaaatgccgccggccgaggatgagtacatcgagcacttgcccgaagagctgctgcgccgcaacgacccgatgtgatcgatcagtgcccgcatcagggcacaggctttaatggaatcgtattagaggacggtggccgtaaggatgcgggcggccgtctgcactgtttttgaaaggtttgaaccatgcgtgttctgattgctgaacaggatcacccgctctacgcccaattgctcaaggaagcggccccagaccttgaagtgctgaccagcggcgattctgccgaactctcgcggctggccgccgattgcccggtatggctgggccagccggatctgctggcgaccctgttgcgccagggccatcacccgcagtggctgcaatcgacctgggccggtattacgccgctgctggccgatggcttgccccgcgactatcgcctgacccgtgcggtggggatttatggccaggtcatggccgagttcgtcctcacctacatgctgggccacgagcgcgaagtgctggcgcgcctggtcagccaggtcgagcgcaagtgggacaaccgcatgggccagagcctggcggggcgcaaggtgctgattgtcggcaccggcgatattggccagagcgtcgccgatttcctcgtgccgtttggtgtcacgctgtacggcatcgccagtacggcgcgggaacaggcaccgtttatcgaagtggccgggctcgaccagttgggccgcttggtgggagaggtcgattacgtgatcaacctgctgcccaatacgcccgaaacccatgacctgtacgactgcgcactgttcaagcaattcaagtccactgcgctgtttatcaacgtcgggcgcggcgtggcggtggtggatgccgatctggttgaagccctgaaagaagggcacttggccggcgcggtgatcgacgtgtgccgtcaggagccgctgccgcagcgccacccgttttggactgcgtggggtttgctgttgaccgggcacagctcggcgccgacctcgccgtcgatgatggtggcgttgtttgtgcaaaacgtgcgcgcctaccaggccaagcaagcgttgcgtggggaagtggacttcgaccggggctactgatccttggccatgcatcaatctaaaatgtgggagggggcttgctcccgatagcagtatgtctgtcagcacatttctaactgacccaccgctatcgggagcaagccccctcccacattggagttgcactaggcttacaggctgaagtcgccctcagacaccagttcagtcaacggcttgcgcgggctcggcgcttcacggccctgcagatactccggcaagctcgacttgtcacccagcttgcccacggccacggccgcatgcaacgcgtacccttgtgggatcttcagctccttgcgggtcagctcctgatcgaaaccggccatgccatgggtatgccagccgctgaggctggcttgcagcgccaagtggccccaggccgagccggtgtcgaaggtgtgccacagcgctggggtttcttccgtggcgcctggagccatgaagtcggttttcgaggcgatgatcaccagggccgatgcatgctgcgcccaattgcgattgaattcgttcagcaggcccaggaaacgctcccagtccggagtgtcccgacgtgcatagagaaaccgccacggctgcgaattgtaggccgacggtgcccagcgtgcggcttcgaagaaactcagcagggtctctttcgggatgctttcaccggtaaaggcgcggggcgaccagcgttctgtgaattgggtgtggatcgggtaatcggcaacgcgtgtcatgggctgttcctgatcgtcaattcggtgctcaaaactactgcgggctcagtagtctgacaagtgttgctacaccgtcagtcgtaagcgcttggccccagcgggcttgggcactagactggcggccttttcagcttccgatactgatgtagagccatggccgccaaagtcgaacctttctggatacgcaaaacccttgaacagctcgaccaggaggagtgggagtcgttgtgcgatggctgtggcctgtgctgcctgcaaaagcttgaggatgaagacgacaacagcgtttactacacgcgtatcgcctgcaaactgctcgacctgaaaacctgtcagtgcacggattatcccaaccgccgggccacggtgccggactgcatccagctcaccccgggccaggccgaccaattcaaatggttgccgccgacctgcggctaccggctggtcagcgagcgcaaggacttgccgctttggcaccacttggtgtgtggcgaccgtgacgcggtgcaccacgaacgcatttcccagtccgggcgcatgctcagcgaaggcagcgtgcccgaggacgactgggaggactacctgatcttccgcgcaggttgaactaaggagtgtgtatgaaggcggcagccaagttagccgcgggcctggtattactggcgctgagcgggccgggctggtgcgcgaagaaagtcgacctggactatcacgtcaagctgctgccccagagcgatcaggcgcaggtgcgcgtcagcctgtcccaaggctcggcggtgcgtagcctggacttcgacctgggccgcgagggtgactacagcgacttcaaggccgacggccaatggcaggtcacgggcagccgtggcctgtggcaacccagcgccgacaaggccagcctgacctacaaagtacgcctgagccatacgcgcaagccgggcgtctatgacacacgggtcacgccgagttgggcgttactgcgcggtgaagacctggtgccggctgcgcgtctcgatcagcaagatggcattgagttggtctcgcgcctggcgttcgagttgcccacgggctggaagagtatcgaaaccgcctggccgcgcattggcaagcataaattccgcattgataacgtgtcccgcctgttcgaccggcccaccggctggatgctcgccggtaacctcggcagccgccgcctgcgcctgggcgaaaccgaaatcacggtggcctcgcccagagggcagggcatgcgccgcatggacgtgctcacactgctgacgtttgtctggccccaggtagaggccgcattcccgcgccatcccggcaaattgttgatcgtcggcgccagtgacccgatgcgccgtggcgcctattcattgcgcgattcgatctacctcaacagccgtacgccattggtcagcgaaaacggcagcagcccgttgctgcgcgaagtggtgcaggctatcgggcgctttaacgaccatgacagcagtgactggatcagtgagggcttgggggaatattacgcggttgagctgatgcggcgcgccggaggcatcaccgatgagcgttatgcggcgatccaggcgcggcttgccaaggagagcaaagcggtcactaccctgaggggcgagcaaatcggcagcgccggtgtagcgcgggcggtgctggtgttgcaggatctggaccgggagatccgtgtgaagacccacaataaacgctccctggatgacctggcgcaggcagtgatgcgggttaacagcattgataccaaggaatttgtgcaactggctgaaagtgtgatcggcgagtcttcagttgttctggacagcaaactactgcgctgatcccaagccatgtgcagttcaaaatatgggagggggcaagccccctcccacatttgatctgtgcggtcttaaagcctggatcaggtttggggttttacagccttttcagccgccacttcggccttggtcttcaagttcttcaactcttccccggcgcgctcgatcttggtacgtacgctgttcatttcctgacggccctgctccagcttgtccttgagcgaactgtgcccggtaaagccacgggccagggccacgccgccaatcgccacctggatcaacccgaaaatcccaccccggcgcaggcctttgccgaccatcatcacgccgcccgccaccgagccgatgcgttcccagccatgcacgttctgggtcggctgagccttcaacggcgtggcttcgatgataggttgtaagattttgctgtcgctcatgatctgtctccaacaagggcaagtgtaactagctgactgcgcgcaggtgccggatgttcccggaaagtcagtacttgggccccgaacgggtgttgttgcctttggccaggcggtcgtagagcaccacattgaccgtggccgccaggttcatgcagccggtggtggggatgtagatcacgtcttcgcaccagtcgcggatctccttgtccagggagccgtcttcggggccgaagatatacagagcacggtcggggtgggtgtattcaggcagcgggcgggcgccttccaccagttccacggcgaccgggatgcagcccaggggcaggatctttttcaggtcgtcgatgccgatcagcggaatgtcgtggtggacctttttggtgtcggtgatgaaatcccgggcgcgctcgtaacgtacgcccgtgtagaacaccgaggccacgccatagcagccggcggcacgcattaccgagccgacgttttcgggggatttggggttatacagaccgatgcagctgtagcgtttattgcccacggggaagggtgccttggagaaaaacggcgattatacggcctgggggtatgcagtgcttgggcgatcgtcaccgcgggcaagcccggctcccacaggggaatgcattccaaatgtggaagctggcttgcctgcgatgaggccagtacagacaaggacgatcttcagtcgtctttcttcatcaaccccgccaacgccgcaaacggattatgcgtcgccttggcaatgctcgggctgctggtggagccttcgccgaagtactgctggtcggtgtagcgcgaatgttcgttgtcgtggcaatacaggcacagcaactcccagttggagccgtcctggggattgtcatcatggttgtggttacggtggtgtacggtcagctcactcaggcgcttgccggcgaattcacgggcgcaacggccgcagacgtgggggtacatcttcaaggctttgtcacgatagcccatttcgcggtcgcgctgggcatcggcgaggatgcggtccagcttggcggtgtgggagggcgggttggtcgagctcatcatggctcctggctatttgatggttcacggataaggtggattctagccgcttgcgcggtaaatgaccgctaggattgcttcactgactgataaggaatggaaattcatgcgtctgcattcatggactatcgggctcgtgctctgtgcccttaccgcccaagcccaggcgttttcgacgccacaaccggggcaggtgatcgaggttgccctggaacaactgcacccgacccaggccgtggttggcttcgaccagatttactacagcctggggctgttcgccgacaagcccgccaaggctttcgacgaatactgcgaaaccaacggccagggcgaggccgaccaggtgcctaagaccgccgaactgctgcggcccgccagcttcacctgcaagcgtgcggtgggcacttatcccgatgagatgaaaaccgtggtggtcggccccggcggccagctgtacctgaccgatggtcatcacagtttcaccaccctatgggagacccctggcgccggcccgcgtttgaaaatgtgggtcaaggtcaccgacgatttcagcagcagcccaaaccttgccaccttctggcaacgcatggaggctgcgcgcaaggtctggctcaaggacaaccagggccagacgctgccacctgcgcaattgccagcgcacctgggcttcaagaacctgcaggacgacacgttccgcagcttggtgtatttcacccgcaaggccgcctatggcaagccaaccgacggtgcgattgcgccggaattcctcgagttctactggggtaactggctgcgcacgcaaattgacctgggcagctacaacctgaataagaaaggcgggtacaaggacgccattgaagctgtggcccaacgcatagtcagcctggcgccgggatcgaaggtgggcgacagcggtttcacggcccggcaattgggtggtatgacccagctggatcacagtgagctggaaaagactttcgataaaaaactgccgtatgtgatcgagtaccgcaaatccagagactgaagcagtaccaaatgtgggagggagctcagcccttcagcttctccgcaatccagatggtatgccgcgtacccttgttgccatgggcaaacacctggacttcctcagccttgaagccggccttgcgcagtttgtcgctgaacagcttatcggcgctcgccgaccacacggccagcacgcccttggggcgcagggccttggcgcacgcggccaggccaccggcggaatacaaccagctattggccttttgcgtcagcccctcggggccgttgtcgacgtcgagcatgattgcgtcgaagccctggggctcggcctgcaacaccttggccacgtcttcaaggcggatcaccgtgcgtgggtccagcagcgggcgcccggacttttcccccagcgccccacggttccactccacaacgtcgggcaccaactccgcgaccaccacttcggcgctcttgcccaaatgcttgagcgctgcggccaaggtaaaacccatgcccaagccgccgatcagcacccgtgagcccgggcggccggccaccttgcggcaggggatctcggccagggcgtcttcggagccgtgcatgcgcgtgttcatcagctggccgccgtcaccgccctggatcttgatgacaaagtcctcgccgtattcgaacaggcacaaggcaccgccattgtcgggaatcggagtggtgtccagcagaacgaaacgtttcatggaaatctcattgggaagggcattcttgcgcagttgggagtagccttacgatattccggtcaggccatggagccatcgatgaagtgcagcattctaacggccattgtattgagcgcgctcatatctgctgtggcgcaggctcaggagttgcaaaccgttccggtcgcgcccgctccaaccccaggcgcgccgggcacgccaacgccgaccttgtacccgcaagtcacgccaccagccgtgcccaagaccaacggctcgccgcccctggtgcccatcgtattgcccgcgccgcccaaggaccagaccgtccccggcctgcagcagaacgatagcaagcccaagacccccggcggttaaaactgttgagataacagttgcccatcggccatgcgcaggcgcttggacagggccacggcaatggcgcggataatcttggccgccacccttggcgcttcattgagcattttttccagggcgtccttgcccaggttcaacagcacgcaatcactggccgcgacgcaactggccgagcgccgctcgccgtcgagcaccgccatttcgccaaacgcccggccactgcgcagggtggcgatggtcaggcgctggccggtgtgattggttttctgcacggccacctggccagtgtggaggatgcacatgaacgtgccggcatcgccctcgaggaaaatcacctcgccctggggaatgctgctgatattgaagtagcccgcggcgatatgaaaatcttcgggcagcaacgggtcaaacagcccgcagtccatcagcatgtcgcggatttcgtcgttgagtaacgtggcttgtggcatggcagcagtattggtccgtcaatatgtagggcggtcccctgttcagacagggccgccccggtaagttcctaaatcagcccgagcgccttgaacacaaacgcatattcgagcgctacgtcacgtaatccctgatagcgaccgctcatgccgccatggccggcgcccagctcggtcttgagcagcagcagattgtcggaggtggcggtgtcgcgcagcttggccacccatttggccgcttcccagtactgcacgcggctgtcgttgtagccggcgatcaccagagtggccgggtaagcctgggcgctgacgttttcgtagggcgcgtaggccttgatgcgcgcatacacctcggggtcctcggggttgccccattcgtcgtactcggtgatggtcagcggcagttccgggtcgagcatggtgttgagcacatcgacgaacggcacttcggcaatcgctgcctggaacagttccggacgctggttgagtacggcgccgatcaacaggccaccggcactgccgccgctgatcgccagttgcctggaggtggtcacgccctcggcaatcaagtgttcggcgcaggcgataaagtcgctgaaggtgttctgcttgtgctgctgcttgccattgcgataccaggcttcgcccaactcaccgccgccacgcacatgggcgatggcaaacgctaccccacggtccagcaagctcaggcgtgcgtgggagaaccacggatcgaggctttggccataggcaccatagccatacaggtacagcggcgtcggctggccgagccggtcacgcttgaccaccaggctgatgggcacctgggtgccgtcagcggaggtggcccataggcgttggctgacgtagtcgtcagcattaaacacgccaagtaccggggtttccttgagcaccacttgggcgcctgtcgccagttcgagctgacgtacctgggccggacggtttaaggcctcatagcgcaggcggatcttgtcgctgtgaaattccaggctgttttgtacatagaggctgtaggccgcatcgggtaactcaacgcgataggccggtacatcttcggggtgcacctcgatgaccggcaggccaccgatgcgcaggctcaaggtcatggcgctggcgttcaggctcacaccgtcgagcataacttcatcgctgtgagggatcaggttctgccagtcggcctcggtaggcggcgtgccgttatcggcagcgatgaacagcgcgtagttgatcccatcgcggttgctgcgaataaaccaggtccattcgccattgcgcttgccatggtcgacatcgtattcatggtcttcgacacgtggcgccaggcaggtaaagcccaggtgcggctggttggcgtccagcgcccagatttcgctggttgtcttgctgcccagggccagcagcagttggcgctcggagctggaacggtagcagtgcaggaagaaacgtccgtcgggctcgtggaacacttcctgcgctgccgtaccatccaggcgatagcgatacagcttgtgcgggcgatgggtgtcgtccagttcgccgaagaacagggtcaggctgtcattggcccaggtcatgctgccgtcgcaattctcgaacgacagttcgctgactttacctgtggccaattccttcacgaacagggtgtaggtctcttcgccgctggtgtccaggctgtaggccaggcgctggtggtcggggctgatgctgaacgcgccgagggagaaaaagccgccgttggccaatgcgttcgggtccagcagcaattcttcgcttctgtcatctacctggttgctgtcgtcagccgggcggcggcagcggtaatggcgcgcatattcgtcaccggcggtggtgcgggtgtagtacaggtacgggccccaaggggagggcagggacaggtcggtttcaaggatacggcccttgatctcttcgaacagggtctcgcgcagcgcctgctggtcggccaactgggcctcctgccaggcgttttcggccttgaggtagtcgagcacttctggggtgtcccgcgcttgcagccaggcgtacgggtctgggcctggggccttgcgggcaatcggggcggtcgatgacgtcatggatcactctctgtctggcggaaggtggcaggcattgcagccgcgacacgcaaaagccgttatcatagccgcctgtttgccaaccttgccatggacaccatgaccgagaacgactatctgaccgcttggggcctctacgccttcgccgctttgggctgcctgttggtgtggtggcgcatgacccgctggatgtggcgctggctgcgcgagccgttgcaattgctgatggcggtgttgttgctgagcccgaccatcgtcgacccggtcaagacccagttcgcgccggccgtggcgattaccgccctggacctggtgctcaaggtcggcaacaacgcctggcgggcgatttccgatctgttcatgtacaccatgatcgtgttcgccctatacatcgtgtttgtgttgatccgctggcccatcgagcgtgcggccaacgcccggcgtgagcgcaaggccgccacggatgctgccctggccgccgagccggaagacgacgaaccgttccgtcgcccggcgccggtgagtggcatgcgggtcgaaccgcgcctttaacgttgtccgccctgcagcgagagccctggcatgtgtgaattattgggcatgagtgccaacgtccccaccgatatcgtgttcagctttaccgggctgatgcagcgcggtgggcgtaccggcccgcaccgcgacggctggggcatcgccttctacgaaggtcgtggcctgcggctgttccaggacccggccgccagcagtgagtcggaagtcgcgttgctggtgcagcgctatccgatcaagagcgaagtggtgattggccatatccgccaggccaacgtgggcaaggtgagcctggccaatacccacccgttcgtgcgcgagctgtggggccgcaactggtgttttgctcacaacggccaactggcggacttcaacccccgcgccaccttctaccgcccggtgggcgataccgacagcgaagcggccttctgcggcctgctcaaccgcgtgcgcgaagccttccccgagccggtagacatcgagcaagtgctgccggacctgatcgccgcctgcgccgaataccgcagcaagggcgtgttcaactgcttgctcagcgatggcgactggttgttctgctactgctcgaccaaactggcgcagattacccggcgcgcaccctttggcccggcgcgcttgaaagatgtcgacgtgatcgtcgattttcaggccgaaaccacccccaatgacgtggtaacggtgatcgccaccgagcccctgaccgacaacgaaaactggacccgctacgaaccgggccaatggagcctatggcgacgcggtgaatgcgtcagccagggcgttaccgagtaaggatatcgaccatgttgcttagctatctgcggttggtgctgtttgccattggcttgttgatcggcgtgcaggtgccggggtttatcaacgactacgccaagcgcgtcgacgcccacctgatcgaggcccagactggcctgcgcggctttgaatccacggcgcaacagtttttcaacggtgatatgcaagcgttggtggcccattaccgtgccagcgatgacccggtgttccagagcgacgccagcagcctgggcgcgatgctcgatcgccagcttgagttggacaagcaattccaggccatgcagggcccgtggtacatacgcgtgctgcaagtggcggtggccgccgacccggatatccgccaggaaacctggaatggctacagctaccagatcttgctcacacccgaagccatgggctggggcctgggtggggcgatgctgttgtcgtttggcatcgaatgcctgtaccgactgattgattgggtggtgttgggcggcaggcgcttgcgtcagagccggcccatcgaagagcgggacctcaagggcctctaacgcccaactcggccaaatgtgggagggggcttgctcccgatggccgcaggtcagtcaacatcttcatcgactgacactctgctatcgggagcaagccccctcccacatttggatccggtttagtcagtggcttagtagcatccgctcttcgccgacttcttcggcgtagcgggccaccaccttctggcacaaccccacaatctcctccaccaactcaacccccacgcgccatgacaccactacctgcaagttcggcaggcgctgggccatcggcagcatcaccaattcgccccgcgccagttcttcgctgaccagtaccggcggcagtgcgccaatgccgaagccatcgcgcagcaaacgggtaatcgccgacaccgagttcacacagttcatccgtggcgcggccacgccgttggcctgcatcaggctgatcacgtcctggtgcgggtgagaatttttcgagtaggtgatgatgcgctcctgggccagttcggccagggaggcgtagtcgcggtgatagatcgattggctggcaacgatccaggccatggggtggctggccagttccaggctgcgtacggtttccaggcgcagcaggtcggtttgcaggatcaggtcgaggaaacctttttgcaactgatcgctgaggttaagcgcggtatcggcgaccaactcgatttccaccagggggaaatgatccatcaactccgcgaccaacgggctcagccaagtgtggatcactgtgtccatcacgcctatgcgaatgcgcccgaccttgctgctgctggtttccagggactgcttcaagccctgcatggtcaccatcatctgctcggcgtaatcgagcaccttcaagccttccggggtcaggctcacgccccgggagtcgcgcaggaacagcttcacgcccaactcgctttccaacaccgcgatgcggctggaaatcgaggcctgggtggtgaacagcttctcggcagtcaggcgaaaactcttgagcttggccacccagacgaaggtttcgaggaacttcaaattcatgggatcaactttttcttatgcatggatcggtttttattagttggacgtcgcaccgggcaagcgccaaaaatcgagctgttccacgataagcgtcgtaggggtgccaggacaagttgcgagttctgtgtaataaatcccacactacaaaaaaacaaagcctacaggagcgaccagcgtgagccgcctgcttttgaactgcgacatcggcgaaagctttggtaactggaccatgggtctggacgccgaagtcatgccgttcatcgactgcgccaacgtggcctgcggctttcatgccggcgacccgagcatcatgcgcaagaccgtcagcctggcgttcaagcatggcgtgcaagtcggcgcccatccggcctatcaagacctgcagggctttggccggcgctcgatgcactacacgccccaggaaatccaggatctgttgcactaccagatcggcgcgctggacggcatctgccgggcccagggcggtcgcgtcagctatgtgaagccccacggcgcgatgtacaacgacatgatggccaacccggcgcagttgcgtgcggtgattcaggccgtggccgcctacggcgacctgccgctgatgctgctggccatgcgcgacaacagcgctgcccaggcattggccgatgaatacggcgtgacgttgtggttcgaagcctttgccgaccgtgcctatgacagcaagggccacttggtttcgcgccagttgcccggcgcggtgcatcacgactccgacaccatcgtgcagcaggccctgaccatttcccttggcgaggcgctggtcgccagcgacggcagcgcgctggtattgcaggccaataccttgtgcgtgcatggcgacaacgccagctcggtggctgcggtgcagcgtatccgtgaggcgttgaagacagcatgaagccacgcattgaagtggtggccatcgattgtctgatggtgcgtctgtttgaggcgattgccgaagccaatatgccgtggatgctcgccgccacccagcgcctgcgggccggattcggccccgcgttggtggacctggtgccgtcctataccaccttgatggtgcattacgatctcacggcgttgaccccagcccaggcccgggaactgatcgaccaggcccttaccgatctgcaaccccaggcacagggcagcggccagtgccatgtgctgccggtgtggtacgacctgagtgtcggcccggaactgaccctgctggcccagcgtagcgggttggcggtggatgaagtgatccgccgccacagcgcccacgaataccaggtgttcgccctcggtttcgccccgggttttgcctttatggggctggtggacgaaaccctcgccacgccgcgcctcagcaccccgcgcaaacgcgtggcggccggtagcgtcggcattgccgaacggcaaacggctgcttacccagttgtgtcaccgggcggctggaacctgatcggccgcactgcggccaagttgttcgaccgcgaacgcgacggctacagcctgatgcagcccggtgacacggtgcgcttcgaagcggtcaatcacgctgaatttatccacctgggaggcgatgacacgccgttggaggcgcaggcatgagcggcttgatcatcgaggccagcacaccgctgtgcctgttgcaggacgccgggcgttttggcgtgcgccacctcggcgtaacccagggcggcgcgctggattgggtatccatgtcctgggccaattggctgctggacaacgccctggatgcgcctgtggtggaagtcaccctcggcggctttaccgtgcaggccgaggactattgtctgctggccttggccggtgcggacctgggcgcgtatatcgatgagcgcgccatcagccccgggcgcagttttatcctgcaaaagggtcagcgtttgcgctttacccagccattcagtggggcacgggcttacctggcggcgccgggcgggttcgatgcgccgcacgtgctcggcagttgcgccacggtggtgcgtgaggcgatgggcggggtggacggtttcggcaaagccttggctgaaggcgcgcggttgacctattccgggaccgggggcgcgatgaaagtgctggccaacccggatttgccatccgctgcatccctggacgtgatcatcggtgcgcagatcggccagttcagcgggcagagcctgtttgatgcgttcaacaccgaatgggtcctggacagccgggccgaccgcatgggcatgcgcttgctcggtacgccgctgcactaccaggggccgtcgttgatttccgaaggtatcccactgggcgcgatccaggtgccgccggacgggcagccgattgtattgctcaatgaccggcaaactatcggtggttatccgcgcctgggtgcgttgacgccgttggcgctggcgcgcctggcacagtgtttgccgggggagaaaatcaggttggcgccggtggtacaagagacggcgcatcggcagcacaacgaatatctgcgccgatttaaataacaccgcccctgatcgtccctacgccgagcgcgggggacgatcttaaggttattcctacgcgtgcccgatgtttgccttctttgttcgatcgcctctccatgcaagcctgatcgtgtcattcactatcaggctttgttatgcgttacttgaagatttttgctcaggacatactcgataacgacattcccgatgttgtctatctggagttttatgacgacacctgcacgcctgcgctggcttataaggcgacggccttcgatattacggatgatggcaagcttgactgggtcatggccgatgatatgaatcaagatggtattgtcgatacagtcgaccggcagatggcacttgagtttgcccagttgttcctggcgtttgagtggttcagcgtcgatgcgccttttgacaagtacttgaaggtgtttgcgggggattttgacaacaacgggattcccgacacggtccgattgcacttccatcagggcgacggcgtggcccgggacgataccctggtctattcggcggcggtttacagtgacggaaatggcctgggcgccagtgtttcgatccatcaggatgtcaacaatgatggaaaagtggaccgccaggatacggagttggtcaaacagttcgccgcgcgcttcctaaagttttcctgggtagacagcgagcactgctgagtgaaatgcctgcagtcgggactaccgactacaggttccagccactattgggaaaagaaccgcttcccttgctccacgcctcgcaacattcgcaggtacacgtaatcgagcctatgggccaaaaaccactgctcggccggacaggcacgccagaattgcctgacttgccctgacggcttgaggccgtcgacctcgagtcgcagcaatgggagcctgtgggctcttcttgttacgagtttgtattatgcgattcttgattctgcgtgcttacgatattaccgacaacgccaggcccgacgtggtctgcctggacttctacgacgacacactcgcgcagccccttgccatggcggctgcagtggtggatatgaagggtgatggcaggcttgattggaagctggctgacgacatcaaccataacggtgtcactgacacgctggatgcagccatggcgctggagttcgcccagcaattcctcgagttcaactggttcagccaggacggcgccgccgataaatacctgatggtgtttgccgtagacttcgatgccaacggcataccggataccgtgcgcctgcattttcaccaaggtgaggggcagctcgatgatgagtcactggcctacacagcggcttattttaccaacgaggtgggcaccgccgatggcgcccatatcagccaggacgtgaacaacgacggccgcgtcaatggcgtcgatgcggaactggtgcggcggttctccagtaacttcctgctgttcggctggcatgatgcgtgcaggcccacaccgtcgacaccaccatgcaaaccggtgctgaatcggccgtaaagggccttccgaggcggcttatttggccaggaagcgcatgccttcctccaggccgcgcaaggtcagcggatacatctgatcctccaccagctcccgcacgatcccggtcgatgcggtatagccccaggtgtccttggggtacgggttaatccagatcagcttcttgtacttggccatgaagcgttgcatccacacatacccaggctcctcgttccaatgctcgacgctgccgccggcctgggtgatctcatagggcgccatggctgcatcgccgatgaagatcaccttgtagtcggcgccgtacttgtgcagcaggtcctgggtggaggtgcgctccgaggtgcggcgctggttgttcttccataccgattcgtacacgaagttatggaagtagaagtactccaggtgcttgaactcggtcttgcacgctgagaacagctcttcgcaggtcttcacatgggcgtccatcgaaccgccgatatcaaacagcaacaacagcttgatggtattgcggcgctcggggcgcatctggatattcagcaacccggcgtcgcgggcggtgtggtcgatggtgccgtcgatatccagctcttcggcggcaccctgacgtgcgaacttgcgcagccggcgcagggcgatcttgatgttgcgcgtgcccagttccacctggtcgtcgaggttcttgtactcgcgctggtcccagactttcaccgccttgccctggcgcttgccggcgtcaccgacacgaatgccttcggggttgtagccaccggaaccgaacgggctggtgccgccggtgccgatccatttgttgccgccggcatggcgttctttctgttcttccaggcgcttcttgaattcctcgatcaacttgtcgaggccgcccagggattggatctgcgcgcgttcttcatcgctcagggagcgttcgaactccttgcgcagccaatcttcggggatgagcgcctgcaggtggtcgtcgagcttctccaggccgttgaagtaggccccgaaggcgcggtcgaacttgtcgaaatgccgctcgtccttgaccaggatcgcccgggccaagtagtaaaactcgtccatgtcggcgaaggtcacgcgttgtttcagcgcgttgatcaggtcgagcagctcgcgcaccgacaccggcaccttggctgcacgcatttcattgaacaggttgagcaacattatcgattaccgcgacggctcatgaaggccagacgttccagcagttgcacgtcttgctcgttcttgaccagggcgccggccagcggcgggatggctttggtaggatcgcgttcgcgcagcaccgcttcgccgatattgtcggccatcagcagcttgagccagtccaccagttcggaggtggacggttttttcttcaggcccggcaccttgcgtacatcgaagaacacatcgagcgcttcgctgaccaggtccttcttgatgtccgggtagtgcacatccacgatcttctgcagggtagggcggtcagggaaggcgatatagtggaagaagcagcggcgcaggaaggcgtccggcagctctttttcgttgttggaggtaatgatgatgatcgggcgcttcttggccttgatggtctcgtcgatctcgtagacgtagaactccatcttgtcgagttcctgcaacagatcgttggggaactcgatatcggccttgtcgatttcatcgatcagcaggatcacccgctcttcggactcgaaggcttcccagagcttgcccttcttcaagtagttgcgcacatcgtgaaccttgtccacacccagttgcgaatcgcgcaggcggctgaccgcgtcatactcgtacaggccctgatgggccttggtggttgacttgatgtgccaggtgatcagccgggcaccgaaggattcggccagttgctcggcgagcatggtcttgccggtgcccggttcgcccttgaccagcagcggccgctccagggtgatggcggcgttgacggccagtttcaggtcatcggtagccacataggcctgggtgccttcgaacttcatcggtcattcctcgaattcatcaatgtccggactataccgcgcagccctggcgactgtgaacgcagacgggttattcagtctctgaatggccggtcacttccgttgaccagtgcgctacatgtgagaggggcaagccccttcccacattttttagtccgcgctgggcttgggttgttcgtaccttgcattaaaggcctggatgaagccattgcgcaaaatcgccaggaacgcggaaaaggcgctgatatcttgctgatgcacgctgccgctgagttctacccgggtcgcaaactggtttttgttctggtttttcaacacggtctcgctggcgccgaccaccgcttcccagattgagcgaaagatatttttgtccttgttctcaacatcctgctgccagtcaaagacttctacgtcacgcagcaatggtttgatataaccgctcagttggcctttctcagcctgggcttcgatcaccacatcgccggtgccggccttgaagtcgaattttccataggcggacgcgaagtcattcatgcgtttgagttgcaagtctctggcgcggaagcggaactcaaagtcttcgaaattgctcagcggatcaaaggtcgcgttggcctccagcggcgcctgccccagcagcagggctttgccttcaaagctggcgtcgcgcttgccttcaacgtctaccacattggtcaggttatagaggctggcattgaccgaggtcgcattgatattgaccggcggctttgagctgaaattgtggaaggcgatcttgccctctcggatgcgcacttcgttcagggtaattggcagcagcttgctcaactgcgctcgccagtcggtgcctttacccgtttgggacgcctgtttgttggcaccgccatcgacgaagttcagctcaggcttgagaaactccacctcggccaccaccgcatggtcgtaccacagcgaatgccagctcaccgacaagtcgatcagcggcgccttgacgaagggcaccggcactttgccgtcgaccttgacgatctgcaggccgttgatcttgtaggcgccacgccacagcgccaggtccacgtcagtgatctggccacggtaatcgcccatgtcggcgagcttgtcgttgaggtagttacgcaccaggtagggcagggccaggtccagggcaaccagcagcaccagcagcgcggcgattgtccataacggccaactgtagcgacgtttcatgggttggttctccttgcttgtaggagattgactgttctgatgaacgcaacgttccaccgtctggacgcgttgaagtacgaggcatacccttggggccttcttcaaagccgtcaataggacccgtcatgagccgtatctttgcagacaacgcgcactccatcggcaatacgccgctggtccagatcaaccgcatcgcaccgcgtggcgtgaccatcctggccaagatcgaagggcgcaaccccggttattcggtgaagtgccggattggcgcgagcatgatctgggacgcggaaagcagcggcaagctcaagcctggcatgaccattgtcgagccaacttccggcaacactggtatcggcctggcgtttgtcgctgccgcccgtggctacaaactgctactgaccatgccagcgtccatgagccttgagcgccgtaaagtgctcaaggcgctcggtgccgagctggtgctgaccgagccggccaaaggcatgaaaggagccatcgacaaggccggcgaaatcgtcgccggcgatccgaccacctacttcatgccggcccagttcgataacccggccaaccctgcgatccacgagaaaaccaccggcccggaaatctggaacgacaccgacggcgccgtggacgtgctggtggcaggggtagggaccggcggcaccatcaccggtgtgtcgcgctatatcaagaacacggcgggcaagccgatcctgtcggtggccgtcgagccgagggtgtcgccggtgatcacccaggcgttggcgggtgaagagatcaagcccagcccgcacaagatccagggcatcggtgccggttttgtgccaaagaacctcgacctgtcgatggttgaccgcgtggaactggcgaccgacgaagaatccaaggcaatggccctgcgcctgatgcaggaagagggcattttgtgcggtatctcctgcggtgccgccatggccgtggcggtacgcctggccgagaagccggaaatgcagggcaagaccatagtggtgatcctgccggactccggtgagcgctacctgtcgagcatgttgttcagcgacttgtttaccgaccaggaaaaccaggcctgactgtaggagcgagcttgctcgcgaaaaacctgagagcgccacgttgtatcagtaagcccgcgttatcgttgaggttcttcgcgagcaagctcgctcctacagagggaaggcgtgttgatccagatcagccagacggcctgggccttctgcataatgctccaagtgtttatcatggccggctattacgtctggtttccgttgacggaagtttgctggccaggcgcttatttccaggagttgctgcatgaccttttccttggccaccaaactgtcggtgttgctgctgtttattggcagcacgctgtatgtccacctgcgcggcaaggcccgtttgccgatgttgcgccaattcgtcaaccattcggcgctgttcgccccgtataacgccctgatgtacctgttctccgcggtgccgtccaagccctacctggatcgcagcaagttcccggaactggacgtgctcaaggataactgggaagttatccgcgaagaggccatgcacctgttcgacgagggctacatccgcgctgccgaaaagaacaacgacgccggcttcggttcgttcttcaagaagggctggaaacgcttctacctcaagtggtacgacaaacccctgccatcggccgaggcgttgtgccccaagaccgtggcgctggtgagcagcatccccaacgtcaagggcgcgatgttcgcgctgttgccgggcggcagccacctcaaccctcaccgcgacccgtttgccggttccctgcgctatcacctggggctgtccacgccgaactccgacgactgccgcatcttcgtcgacggccaggtctacgcctggcgcgacggtgaagatgtgatgttcgacgaaacctacgtgcactgggtcaagaacgaaaccgatcagacccgcgtgattctgttctgcgacatcgagcgaccattgagcaaccgcctgatgacccgtatcaaccgctgggtcagcaagcaactgggccgggctaccgctccgcagaacctcgatgacgagcgcgtgggcggcatcaaccaggcctacgcctggagcaagacgttcagtgacaagttcagtggccaggtcaaacagtggaagcgcaagcatcccaaggcctaccgcattgcgcggccggtgctggcggtggtggtgttggtgctgttgtggaagtggttgttcggctgattgtgatttcttgacttgaaatgcagccaaatgtgggagggggcttgctcccgatagcggtggatcaggtatagatatttaacctgacataccgccatcgggagcaagccccctcccacattggtttgcggtgttgcttatgacgcgatcaactgccgcaatacgtagtgcaagatcccacccgccttgaagtattccacttcattcaaggtatcaatccggcacagcacctcaaccttctcgctgctgccatcttcccgggtaatcaccagtgtcaggttcatccgcggttcgatctctgcatcggtcagcccgaggatgtcgatcttctccttaccggtgagcttgagcgtcttgcggttctggtccagcttgaactgcaacggcaatacgcccatgcccaccaggttggagcggtggatgcgctcgaaactctcggcgatcaccgccttgacccccagcaggttggtgcccttggctgcccagtcacggctggagccggtgccgtattcctggccggcaatcaccaccagcggcgtgcctgaggcctggtacttcatcgacgcatcgtagatcgccatcttctcgccggtggggatatacagcgtattgccgccttcctcgccgccaagcatttcattgcggatgcggatattggcgaaggtgccgcgcatcatcacttcatggttgccccggcgtgagccgtaggagttgaagtcacgcggctccaccccttgctcgcgcaggtagcgcccggccgggctgtcggtcttgatattgccggcaggggagatgtggtcggtggtcaccgaatcccccagcagggccaacacgttggcgcccttgacgtccttgatcaccggcaggggtccagcaatgtcgtcgaagaacggtgggtgctggatataagtggaatccttctgccacacgtaggttgccgcttgtggcacttcaatcgcctgccattgctcgtcaccggcaaacacctcggcgtattccttgtggaacatgctggtactgacctgggccaccgcgtcggcgatctcctggctgctgggccagatgtccttcaggtacaccgggtttccattctgatcgttacccagtggctcgctgctgatgtcgatgcgcacagtgccggccaacgcataggcgactactaggggcggcgaggccagccagttggttttcaccagcgggtgcacgcggccttcgaagttgcggttacccgatagcaccgaggccacggcgaggtcggccttctggatggctttttcgataggctcgggcaacggcccggagttgccgatacaggtggtgcagccgtagcccaccaagtcgaagccgagcttgtcgaggtattgggtgaggcccgcggccttgtagtagtcggtgaccaccttggaacctggggccagcgaggtcttgacccaaggtttgcgggtcaggcctttttccacggcttttttagccaccagcccggcagccatcattacactggggttggaggtattggtgcatgaggtaatcgcagcgatcactacggcgccgtttttcaggcgataggtctggccgtcgtattcatagtccgtttcaccgaccaggtcggcattgcccacggccacaccgccaccgccttcactttccaggcggccttcttccttgctggtgggtttgaattgcaggtcgaggaaatcgctgaacgcttggccgacgtttggcagggatacacggtcttgcgggcgcttgggcccggcgaggctggcttcgacgctgcccatgtccaaggccagggtgtcggtgaatatcggctcctggccagcgttgcgccacaggccctgggccttggtgtaggcttccaccaatttcaccgtttcagccggccggccggacaggcgcaggtaatccagagtcacttcgtcgaccgggaaaaagccgcaggtggcgccgtattccggagccatgttggcgatagtggcgcggtcggccaggggcaggtcggccaggccgtcgccgtagaactcgacgaacttgcccactacgcctttcttgcgcagcatctgcgtgacagtcagcaccaggtcggtggcggtgatgccttccctgagcttgccggtgagcttgaagccgatcacttccgggatcagcatcgacaccggttggccgagcatcgcggcttcggcttcgatcccgcccacgccccagccgagtaccccgaggccgttgatcatggtggtgtgggagtcggtgccgaccagggtgtctgggaaggcgtaggtgcggccgtcttcctccttggtccacacggtgcggcccaggtattcgaggttgacctggtggcagatgccggtgcccggcgggaccacgctaaagttgtcgaaggcgctctggccccagcgcaggaaggcgtagcgttcgccgttgcgctgcatttcgatatcgacgttttgctcgaaggcgctggtactaccgaacttgtcgaccatcaccgagtggtcgatcaccaggtccaccggcgacagcgggttgatacgctgcgggtcgccaccggccttggccacggcggcgcgcatggcggccaggtcaaccaccgcgggcaccccggtaaagtcctgcatcagcacacgggcggggcggtactggatctcgcggtcagactggcgctctttaagccaggcggcgatggccttgaggtcggtgccggtgacggtcttggcgtcttcccagcgcagcaggttttccagcagcaccttgagggacatcggcagcttatccaggtcacccaggctcttggcggcttcgggcaggctgaagtagtggtaagtcttgctgtctatttccagggtttttagggttctcaggctatcaagggatgacattacatgactccttatggtccgcacggctacggacctgacgggacgaacagagctatcacgttagcgctgttttcaatagcaagctaataactggactctatcgccgagcccaaggttccgaactcggctatcatgcgcgcgttttcatgacaggcattgcgatagcgcaaggtcagttgattcaccaggagagttgatgaacaccctttttatgcactgccgccccggctttgaaggcgaagtctgttccgagatcgcggaacacgccgcgcgcctgaacgtttccggctacgccaaggccaagaccggcagcgcctgcgccgaatttgtctgcaccgaggaagacggcgcccagcgcctgatgcacggccagcgctttgccgagctgattttccccaggcagtgggcgcgtggggtgtttatcgacctgccggaaaccgaccgcatcagcgtgatcctcacccacctgcgcgacttcccggtgtgcggtagcctgtggttggagatggtcgataccaatgacggcaaggaactctcaaacttctgcaagaaattcgaagtgcacctgcgcaaagccctgctgggcgctggccggctggtggacgatccgagcaagccgcgcctgctgctgaccttcaagagcggccgcgaagcgttcatgggcctggccgagtcgaacaactcggcgatgtggcccatgggcatcccgcgcctcaagttcccacgtgacgcgcccagccgttcgaccctgaaactggaggaggcctggcatcactttatcccccgtgaccagtgggacgagcgcttgcacggcgacatgaccggcgttgatctcggcgcagcgccgggtggctggacctggcaactggtcaaccgcggcatgctggtgaccgccatcgacaacggccccatggccgaaagcctgatggacaccggcctggtgcaacacctgatggccgacggtttcaccttcgtacccaagcaaccggtggactggatggtgtgcgatatcgttgaaaagccggcgcgtaatgcggcgctgctggaaacctggatcggcgaggggcattgccgtgaggcggtggtcaacctcaagctgccgatgaagcagcgttacgccgaagtaaagcgtctgttggagcgcatcgaagagggcttcaaagcacgcggcatacgtgtggagatcggctgcaagcagctttaccacgaccgcgaggaagtaacgtgccacctgcgccgcctggtagacgtaaagaaatccaaaagccgctgagatcaaaatgtggcagcgggcttgcccgcgatagcggtataacagtcgaaatctatgttgaatgtgcccacgtcatcgcgggcaagcccactcccaacataagagcgggcctgtttcaggagtgaagtatgagtgttgatttacccgtagacggcaccctcgacgccaccgggctcaactgcccggagccggtgatgatgctgcaccagcatatccgcgacctgccggcgggcggcttgctcaaggtgatcgccaccgacccgtcgacccgccgtgatatccccaagttctgtgtgtttcttgaccacgaactggtggaccagcaggagcaggcaggtacctatctgtactggatccgcaagaagctcgattaacccctcgccttgtctgcgtgaatgcgtcggcgtgcactgcgcgccaggcgcaccagcaacatccccgccgcacagctcaagccgacgatcagcccttgccacaagccgcttgggccgctgggctcgccgagccagtcggtcagccccagggcgtaacccaccggtaaccctacgccccagtaggcgaacaaggtcagcaccatggtcacccgggtgtcctggtagccgcgcagtgcgccggccgcggtgacctggatcgagtcggagaactggaacagcgccgagaacacaatcagcatcgaggccaggtggatcaccaccgggtccggcgtatagatcgctgcgatctgctcacgaaacaccagcatcaggctgcacgacaggcacgcataggccaatgcggtgcccatgccgaccccggcagcgaagcgcgcttcgcggggctcgccacggcccagggcctggccgacccgtacggtcacggccatgctcagggagtaggggatcatgaacaccagggagctgacgttgagtgcgatctgatggccggacaccacggtagcaccgaggctgccgagcaacagggcaatcaccgcgaaaatgctcgactcggcgaagatcgccacaccaattggcaggccgatgcccaatatgcgcttgatcaccgtccactgcggccagtcgaatcgcttgaacaattcactgctctggtaagccgggccccagcgcgtccagccggccaggccaagcatcatcacccacatcgcaatcgccgtggcccagccgcagccaacaccgcccatggccggcaggccgaggtggccgtagatgaagatgtagttcaacggaatattcagcgccaggccgcacaggcccatgaccatgctcggccgcgtgcggcccagcccgtcgctgaaacagcgcagcacgtaatacagcgcaatcgccggcatgcccgcggcgatgccatgcaggtaacccatggacggctcgatcaggtcaggctcgaccttcatcgcatgcaggatcggctcggcgcatagcaacaacagcgcgccgcagaggccgaccaccacggccaaccacaacgattggcgcaccaacggcccgatctcggtgagtttgcccgcgccatagcgctcggcaactttcggcgtggtggccagcaaggtcccggtcatcagcaggtacaccgggatccagatcgagttgcccaggccgaccgccgccaggtcctgggggctgacacgcccggccatcaccgcatcgacaaagctcatcgcggtggttgccagttggccgatcatgatcggcaaggccagcgtcagcaggccgcgcacttcccggctgatgcgcgcggggcgggagagggtagcggtggcagtgttcacgtacaggtgtccaatcaaaaggcagtcgcaaggacggcggattctacgctttgacgcagcggtcaggaaaaaacctgtgttgctgatttgtaatgcgaccacgcaggcacccccctcgcacattggatcctcacaagcctgtacactgctgatccgccaaaggagcctgccatgctgattgttgccgacgaaaatatcccgctgctcgatgcattcttcgaagggtttggcgagattcgccgtgtgcctggccggtccatcgaccgcgccaccgtcgcgcaggccgacgtgctgctggtgcgctcggtgaccaacgtcaaccgtgccttgcttgaaggcagcaatgtacgtttcgtcggcacctgcaccatcggcaccgaccacttggacctcgactacttcaaacaggccggtatccaatggtccagcgcgccgggctgcaatgcccgtggcgtcgtggactacgtgcttggcagcttgcagaccctggccgaaatcgaaggggtcgagcttggccagcgcacctatggcgtggtcggggccggtgaagtcggcgggcggctggtcaaggtactcaagggcctgggctggaacgtgctggtctgcgacccgccgcgccagatcactgaggatggtgactacgtcagcctgcagcagatcatcgagcagtgcgacgtgatcagcttgcacacaccgctgaccaaatcgggcaatggctccacctggcacttgttggatcgccagcgcctggagcagctcaagcccggtacctggctgatcaatgccagccgtggtgcggtggtggacaacgccgccctgcgtgaggtgctgctggcccgtgacgacctgcaagccgtgttggacgtgtgggaaggtgagcccgaggtggatgtcgacctggctgacctgtgcgtgctggccacgccgcatatcgccggctatagcctcgatggcaagcagcgcggcacggcgcagatctaccaggcgttctgcgcgcacctgggccaggagccgagtgttcagttgagtgatttattgccggcaccgtggctggccgaagtgcatcttaacgcagccactgatcctgcctgggcactggcgaccctgtgccgcagtgtgtacgacccgcgccgtgacgatgcggacttccgccgcagcctggtcggcacggtggaggaacagcgcaaggcattcgacctgctgcgcaagcactatccgctgcggcgtgagattgacggcttgaaggtgcggatcaacggtgagtcggcggcgctggccgctatcgtctcggccttgggcgccgaagccctgtagacactcataaaaaacccggccacctgggccgggtcttaaagagcgcgggcgtatcagccttgctgggcaggtttgaccagacgctgttccagctcgctgcaggcttgctggatcatctcttcggtaatctgcacttcgcggcccttggcatcgatgtacgagcatggcagttgctgcggctggcggatcacttcaatcttggcattgctgctatcttgcaaggtcatggcctgtctcctcatcaggttgtgtacctactttaaatcccccgcgtgaacgcgctgttacaactccctacgcgatcatcggttcgaacacccagtccaccagaaaccggtacatatttccagatgagtcttagaccgatagcctctatgggcttgcgtcggcgggcataattaacctgactcattgttattcacgcaagttcccccaatgttgaggtacacagactcctcattggtgatgtcccatgctctcgacccgtcaacgccgtgcgattcgcgtggccagccgctttattgcgccctatcgctggcaggcgctgggtgccctgttggcgctgatcgtcaccgccggcattactttgtctatggggcaaggtattcgcctgctggtggaccaaggcttcatgacccagtcacctcatctgcttaaccagtccatcggcctgttcatggtgctagtgttgggcctggccgtgggcaccttcacgcggttttacctggtgtcgtggataggcgagcgggtggtggcggatattcgccggcaggtgttcaaccacctgatctacctgcaccccggcttctacgaaaacaaccgcagctcggaaatccagtcgcggctgaccaccgacaccaccttgctgcaatcggtgatcggctcctcgctgtcgctgttcctgcgtaatgccctgatggtcatcggtggcatcgtgctgctgtttgtcaccaaccccaagctcaccagtatcgtggtggtggcgttgccgctggtgctggcgccgatcctgatcttcgggcgccgcgtgcgcagcctgtcgcgcatgagccaggaccgcatcgctgacgtcggcagctatgttgccgagaccctgggccagatcaagaccgtgcaagcctataaccaccaggttcaggacgaacagcggttcgctgtgacggtggaagacgccttcaccaccgcacgtaaacgcatcctgcaacgctcctggctgataaccctggtgatcatgttggtgcttggcgctgtgggcgtgatgctatgggtaggcggcatggacgtgatcagcgggcgcatttccggcggtgagctggccgcatttgtgttctacagcctgatcgtcggcagcgccgtcggcactctgagcgaagtgctcggcgagttgcagcgtgccgccggtgcggccgagcgcatcggtgagctgttgcagtcgagcaacgatatccaggcgccggccaatggcagcgaacgcctgccggaacgtgtcagtggccgcatggagcttaaagacctgcgcttttcctacccctcacggccggacagttacgccatcgatggccttaacctgaccatcaatcccggcgaaaccctggcgctggtaggcccctccggcgcgggcaagtcgacaatcttcgacctgctgctgcgcttctacgatccccagcaaggtcgcatcctgctcgaaggccacccgctgaccgagctggaccccctggacctgcgtcgccatttcgccttggtgtcccagagcccagcgctgtttttcggcagcgtcgaggaaaacatccgctacggcaagccgtctgcgaccatggccgaggtcgaagccgctgcgcgtatcgcccatgcccacgacttcatcctgcagatgcccgacggctaccagacccatcttggcgatggcggcatgggcctctccggcggccagcgccaacgcctcgccatcgcccgcgccttgctgatagatgcgccgatcctgttgctggatgaggccaccagcgctctagacgcgcagagtgagcatctgatccagcaagcgctgccgcaactgatgcagggacgaaccactttagtgatcgctcaccgcctggcgaccgtcaagaatgccgatcgaatagcggtgatggatcaaggcaagcttgtggccgtgggtacgcataggcaattgattgcgagcaatccgctgtatgcgcggttggcggcgttgcagttcagtgaagggggggagacggaatgaagctgcgatacccctgctcaatgaggcatcatgtgatctttcgttattgatctggatgaggacatgagccgttatcaacctccgttgacgctgactccaaaaatgctggcccttgtggcagatatcagtgagcagattggtcagctttcagtcggtgacgatggccgccagacgcatcagttaaggcgcggcaatcgaattcgcaccattcaggcttcactggcgatcgaaaacaacacgctcagcgtcgagcaggtgacggctgttctggaaggtaagcgggtgctgggcttgccccgggaaattcaggaagtgcgtaatgcatttgctgcttacgaggccatgccgcagtggaatccaggtgatcgtgtcgacctgctcaaggctcacgaactgctcatgtttggattgatcgacgatgtcggtcggtttcgacagacaggtgtcggcatctatcgcggcgagcaacttgtccatatggcgccgcctgcgagccgtgtaactcacttggtggacgatttgctgcaatggctggcggtttccgactggcatccgttgatagccagttgcgtcttccattatgagttcgaattcattcatccatttgcagacggtaatgggcggatggggcggctctggcaaaccttgatactcagccagtggcgctcggtgctggcatacctgccggtggaagcggtgattcgagagcagcaagaggcttactacgccgcactgtccgcagcagaccagcaaacgcaggcaacgccctttgtagagttcatgctacaggcgttgaacttggcgctggccgaagctgggcaaagtgggcttccagcagcaccataaaaaatgcccgcatttatcaatgcgggcattttctcacagcttcaaacttatcgcttgaagctgctcttatcactgatcgtcaaaataccgctcatgccaatccaccagcggctgcggcgaattgagcttctgcccgtagatcaccgaataagacagcacgttctgcacatactggcgggtttcgtcgaaggggatgctttccacccagacatcgaaactcaggtggtctgcgccgcgcagccactggcgcacgcggccggggccggcattgtaggcggcggaggcgagcacgcggttgccattgaactggctgtgcacttggctcaggtaggcggcgcccagctggatatttttgtccgggtccagcacctgggccggggaggccagggggatgctgaacttgcgcgcggtttccttggcggtgccgggcatcagttgcatcaggccgctggcgccgacgccggagcgggcgtcgtccataaaagcactttcctggcgcgttatagcgaatacccagctcgaatgcaggccgcggaccttggcttcgcgcaccagggtgtcgcggtgggccatcgggaagcggatatccagatcgtcccagtactgcgcctggctgatggtgcggatggccgggaagtaccacttcatgtcgtaggccagcttggcctgggcaaccatctcgtcgcggttgaagtggcggctgacgtgataccactcgcggcggccgtcgacgatctggccgcgggcatagaactccagggcacggcgtacacctggggtattgcggaccttgttgaccagcgcctggctcatcaccagcggcttattgttcaactggtagggggattttgagcgatcagcggcgagaaagccgtagaagtcccgctccttggccacgttcttgtaaagcaccagcgcctgcgggttttgcggctcggccagctccaggctgcgcgcctgccagtagcgccaacggttgctggtggccaggtcttgtggaagcttgcgggtcaactggtaggcatcttcccaacgtgccaggcgcaacagcaggcgcaggcgccattcggacacggtgttgtcgcgcagttccgggtcgtacttggtcatcacttccagcgcgcgcgggtcgaagcgcttggccagggtcaggccaatctcgcgggcaatcgacactttttcgtcacgggagaagtgcatgctgctggcataaccgtcgagcagggccatggccttgtccggatcctggcgcgccaggcgacgcaggcccaggcccacggcgtccgacatcgcttcggtggccggcaggaagcgtgacgggtcactgagcatgtcgggcttctgcgccacatccaccatcagccggccctgggcgccgagggttggcagggttttcaccaggctgttggccagcgcgtagttacgagcttcggcggcgagtttggcgcggtcccagatcttctgttcggtcagctggccggcagcggcccattggccgaacgtagcgtcacaagcggtcggctgggttttgccggtcatccatagtttttcggcggtcttgtagccttcagccttgagattgtggctgagctggtactggccatgcaggcagtccagttcgacgaaattgagcttggggtcgtagtacttttcaaaggtctgccaatcgccacgttcggccagccagcgtagccaacgcagtttcatccagttggcctggggcaggtcgccgtgtttggcgaggaactgttcgatttcctcgttgctcgcggttttcaggcgtgcggtcagctcgtcatacgccaggtacggcgtgagcgggtagtcggccagggcctggctgtattgcatgtaggggccgctgtcacccttggccagggcgcgtttggcttgatcgtaatactgacgttgggtagtgaggtccaccgcttgggcggattgaacggcagtggcggtaagaagcaggcaagataaaaagttgaaaaggcgactgcgcatgagacgtccgtgcagagaaatcacgactagcaccggcactgccgacactgattgcccctagcttagccttttgccagcggcccgcgaaagctttgccggtcggtcggttgaagatcgccggaaatgtcctacagaacgtgtcgatagagaaaatcccgaccgcatcccaccctcaagtcaggtagaatgcgcgcccagtttttggagaagcgtatgaccctgctcaaattcagcgatgtgtcccttgctttcggcgccatgccgttgttggacaaggtgtcctggcagatcgcccgtggtgagcgggtgtgcatcatcggccgcaacggcaccggcaagtccagcatgatgaagctggtaaaaggcgaccagaagcccgatgacggctcagtctggcgtgccccgggcctcaagatcggcgaattgccgcaagaattgccggtggccgacggacggacagtgttcgacgtggttgccgaaggcctggacggcgttggcgagttgctcgcgcaataccatcacctggcgcagaactgcgtcaccgaggaagacctggacaagctgatgcacgtccagcaagacctcgaagcccgtgacggctggcgcttgcagcaactggtggacagcaccctgagccgcctgcaactgccggcagacaagaccctcgccgaattgtccggcggctggcgtcgccgtgtgctgctggcccaggcgctggtgtccgagccggacctgctgctgctcgacgaaccgaccaaccacctggacatcggcgccatcgcctggcttgaagaagccatcaaggacttccagggcgccgtgctgtttatcacgcacgaccgtgcattcctgcagagcctggctacgcgcatcctcgagctggaccgtggcggcctgatcgactggaacggcgactacgccagcttcctggtgcacaaggaagccgccctggctgccgaagaaacggccaacgcgctgtttgacaaaaagctggctcaggaagaagtctggatccgccagggcatcaaggcccgtcgcacccgtaacgaaggccgcgtacgtgccttgaaagccttgcgcgtcgagcgtagcgaacgccgcgagcgtaccggcaaggccaatatccagctggataccgccgacaagtcgggcaaacaagtcatggtgctggagaacgtcagcttccatcacccggacggcccgttcctgatcaaggacttttccatggtcctgcagcgaggcgaccgtattggcctgctgggcgccaacggcaccggcaagaccaccctgttgaagctgatgctcagcggtctgcaaccgaccagcggcaaggtggaagagggcacgcgcatcgacgtggcctactttgaccagttgcgccatcagttggacctggaaaagaccgtgatcgacaacgtcgccgaaggccgcgactttatcgacatcgacggccagagccgccatgtgctcagctacctgggcgacttcctgttcagcccgcaacgtgcgcgtacgccggtcaaggctctgtccggtggtgagcgtgcgcgtttgctgctggccaagctgttcagcaagccggccaacctgctggtgctcgacgaaccgaccaacgacctcgatgtggaaaccctcgagttgctcgaagaagtgctgctgacgttcaacggcactgtgctgatggtcagccacgaccgggaattcctcgacaacgtggtcaccagcaccctggtctttgaaggtgaaggcaaggtgcgcgaatacgtcggtggttaccaggactggctgcgccagggcggctcgccgcgtctgctgggagtgaccgagagcaagtccggcaaggccgacctgtcctcggcggtggtgactcctgtgcaagaggctgcaccggcccaggaagctgcaccagcggccaagaagaaactcagctacaagctgcagcgtgagctggaagccttgccgggtgagatcgacgccaaggaacagcagattgccgcggtagaagcgcaaatggctgacgccggtttctacctgcgcccggcggcagaaaccgctgcggtcatcgcttccctggagacgttgaaccaggagctggaagcgttggttgagcgttgggccgagctggatgcctgagtgattgctgggcaataaaaaacccggtgttcatctgatgagcaccgggttttctatatgaagcgcgattcaaaatgtgggaggggcggtgcgacgattcgacttgcccctcccacattagcctccatcggtcttacgaattttttaccagcttgacggccagtacatcgcacggcgcgccgtgcagtacatcattggcagtagaacccagcaacaacgccaaaccgtgacgaccatggctacccaccacgatcaagtcgcaagccttttccttggccaagtggtggatttcctggcgcggttggccgtatgtcaggtggcagtcttcctttttcaggtgcgggtatttgagaatcaaacggtccaggcgctccttggcctggtcgaattgttgttgctgcaactgggaaaggtccatcggtacgtcaccgccaaaggccatggccatgggctcgacgatatgcaccagcgacagtatggcgccattggccaatgcagattcctgcgcgcgcttgatcaccggatcgcactcttcggtcagatcgacagcgaccagaatatgtttgtagggcatgaggcgttcctccaagggactgcaataagttcagtatggctgctttcaagcggatggggttgcgtcaggtcaaatccgctcatctagaaattcgggagtacacatatgacggtgtggatagtggtgtcaatccttgcggtggttttaagccccctggcctggctgcgcccgtcgcgtggacagagcgggcgcatggccctgcgcatggaggcgcgccgcatcggcctggccatgcagctcgcgccccaggagtggccgcattggctcaagcaggagccgccgagcccctgtgcgcaatactgtcggccacgtcgcggcagcaccccggccctctggagttactggcagctggagtcgggggtgtgggtcaatcaatggcgtgaagtgtgcgtggatgaaaagttgttgccgcattttgcgacgctgccggcgaacgtctacaaggtcgaggccgacaagcagatgatagccttgtactggggcgagaagggcgacatgagtgtgttgaaggatattgatgcgttgctcagggccttggcctgacactcctacagaggccgggcaataaaaagcccgacatcatcatcgggctggaggtggccaggcaggccggtaaatctgcaagttgccgctagcctagccgtatatccctttctgtacagccatttcccacatcttttctattattgatcttgtgaatatttaaatattgacgggttgcccgcccgtggtccgggttctgaaatgactggaaagtcgcgtttttcctagcctttggagcgattgacaattgctcggaattggatgaaggtggcgtacccaaatcaaacgggcgtatgaattgagcgtttgcctgtcagacgactcgtacagaatcccgactatcgcactggcgggtgtgcctggctgattggcgtgagcattgatgcaactgtcaatgtcaaaccagcgaccagcgtccagtgtgtactgttcagcttccatatcgtggagatcagttgatgatttacgaaggtaaagccatcacggttaaggctcttgaaagtggcatcgtcgaactcaaattcgacctcaagggtgagtccgtcaacaagttcaaccgtctaaccctgaacgaactgcgtcaggccgtagacaccatcaaagcagatgcttcggtcaagggcgtgatcgtctccagcggcaaggacgtgtttatcgtcggcgctgacatcaccgaattcgtcgacaacttcaagctgcccgatgccgagctggtggctggcaacctcgaagccaacaagatcttcagcgatttcgaagacctcaacgtgccgaccgttgccgcgatcaatggcatcgcgctgggcggcggccttgaaatgtgcctggcggcggatttccgcgtcatgtccgccaccgccaagatcggcctgccggaagtcaaactgggcatctacccaggttttggcggcaccgtgcgcctgccgcgcctgatcggtgctgacaatgctatcgagtggatcgccgccggtaaggaaaacaaggccgaagacgccctgaaagtcggtgctgtcgacgctgttgttgccccggacaaactggccgaagctgcgctgaacctgatcaagggcgccatcagcggcgaatttgactacaaggccaagcgtcagcccaagctggaaaaactcaagctcaacgccatcgaacaaatgatgtcgttcgaaaccgccaagggtttcgtggctggccaggccggcccgaactacccggcgccggttgaagcgatcaagactatccagaaggccgcgaacttcggtcgcgacaaggcccttgaagtggaagcggccggcttcgtcaagctggcgaagacctcggcggcccagagcctgatcggcttgttcctgaacgatcaggagctgaagaaaaaggccaaggcctacgacgaaatcgccaaggacgtgaaacaggctgccgtactcggcgccggtatcatgggtggcggcatcgcctatcagtcggcgtccaagggcacgccgatcctgatgaaagacatcaacgaacacggtatcgagcagggcctggccgaagccgccaagctgctggttggccgtgttgataaaggtcgcatgaccgcggcgaaaatggccgaggtgcttaatggcattcgtcctacgctgtcttacggcgatttcggccacgtcgacctggtggtcgaagcggttgtcgagaacccgaaggtcaagcaggccgtgttggctgaagttgaagcccaggtcaaggacgacaccatcctggcgtccaacacctcaaccatttccatctcgctgctggccaaggccctcaagcggccggaaaacttcgtcggcatgcacttcttcaacccggtgcacatgatgccgctggtggaagtgatccgtggcgagaaatccagcgagctggcggttgccaccaccgttgcctacgccaagaaaatgggcaagaacccgatcgtggtcaatgactgcccgggcttcctggtcaaccgcgtactgttcccctacttcggcggtttcgccaagctggtcagcgccggtgtggacttcgtgcgcatcgacaaggtcatggaaaaattcggctggccaatgggcccggcgtacctgatggacgtggtcggtatcgacaccggccaccacggtcgcgacgtgatggctgagggcttcccggaccgcatgaaagacgaccgccgctcggcgatcgatgcgctgtacgaggccaagcgcctgggtcagaagaatggcaagggtttctacgcctacgaggccgacaagaagggcaagcagaagaaagtggccgacccgtcggtgcatgaagtgctggctccggttatctacgaacagcgtgaggtgtccgacgaggacatcatcaactggatgatgatcgccctgtgcctggaaaccgtgcgttgcctggaagacggcattgtcgagaccgccgccgaagccgatatgggcctggtgtacggtatcggtttccctccattccgtggtggtgcgctgcgttacatcgattcgatcggtgtggctgagttcgttgccctggctgacaaatacgctgatttgggcccgctgtaccacccgaccgcgaagctgcgtgaaatggccaagagcggccagagcttcttcggttaagtgcccagacgactagagcgagaatatttatgagcttgaatccaagagacgtcgtgattgtcgacttcggtcgtactccgatgggccgctccaagggcggcatgcaccgcaacacccgtgccgaagacatgtcggcgcacctgatcagcaagctgctggaacgcaacgtcaaggttgatcccaacgaagtcgaagacgtgatctggggctgcgtcaaccagaccctggagcaaggctggaacatcgcacgcatggcttccttgatgacccagatcccgcacaccgcggctggccagaccgtcagccgcctgtgtggctcctcgatgagtgcattgcacaccgctgcccaggcgatcatgaccggcaacggcgatgtattcgttgtcggtggcgtggaacacatgggccacgtcagtatgatgcacggtgtcgatcctaacccgcacatgtcgctgtacgcggcgaaagcctcgggcatgatgggcctgaccgcagaaatgctcggcaagatgcacggcatcacccgtgaggcccaggacgcgttcggcgtgcgttcccaccagctcgcccacaaggcgaccgtggaaggcaagttcaaggatgaaatcatcccgatgaacggctacgacgagaacggcttcctgaaactgttcgattacgacgaaaccattcgtccggacaccaccctggaaagcctggcggccctcaagccggctttcaacccaaagggcggcaccgtgaccgccggtacgtcgtcgcaaatcaccgacggtgcctcgtgcatgatcgtgatgtcggcgcagcgtgcccaggacctgggtatccagccgctggccgtgatccgttcgatggcagtggcgggtgtggacccggcaatcatgggctatggtccagtaccggccacacaaaaagccttgaagcgcgcaggcctgaccatcaacgacatcgacttcttcgagctcaacgaagctttcgccgcacaggccctgccagtgctgaaagatttgaaagtgctcgacaagatgaacgagaaggttaacctgcacggcggtgcgattgccctgggccacccattcggttgctccggtgcacgtatctccggcactttgcttaatgtgatgaagcaaaatggcggcaaccttggggttgcaaccatgtgcattggtctcggccaaggcatttccaccgtcttcgaacgcgtctaagcgtttcgttgacggaagccggggcccagtgccccggtttttgttttttgaaactttttaatattttttttcaacaaattttgtaagggggccagagcatgaaagtcgaaccagggctctaccaacattataaggggccgcagtaccgcgttttcagcgtggcacgccactccgaaaccgaagaagaagtggtgttctaccaagcactgtatggcgaatacggcttttgggtacgccccttgagcatgttccttcagaccgtcgaagttgacggcgagcaggtcccgcgctttgctttggtccaggccgaacccagtctttttaaagggcaataacggcaggtcgcgcagaatgctgcgcttgacctcaccttgttgccactatatatagcgttgccgcgtcaggcgccaactgcctttcacttctcgaattcaggaactttccgatccatgggcaaatcgctggtcattgtggaatccccggctaaggccaagaccatcaacaagtacttgggcaacgagtacgtggtgaagtcgagtatcggccatatccgagacctgcccaccagcggttcggctagcgccagcaaggagcctgccgccaagcgcggcaaggcggctgcgggcgaaggtccggtgctcagccctaaagagaaagcgcgcaagcagctggtctcgcgcatgggggtggacccggaccatggctggaaggccaagtacgaaatccttccgggcaaggaaaaggtcatcgaagagctgcgccggctcgccaaggatgctgacaccatctatctcgcgacggacttggaccgcgaaggggaagccattgcctggcacctgcgcgaagccattggcggcgatgacagccgctacaagcgtgtggtgttcaacgaaatcaccaagaaagccatccaggaagccttctccaagccgggggagctggacattgaccgcgtcaatgcccagcaggcccgtcgtttcctcgatcgcgtggtgggctatatggtctcgccactgctatgggcgaagatcgcccgtggtttgtccgctggccgtgtgcaatcggtagcggtcaagctggtggtagagcgtgagcgcgaaatccgtgcgttcaaccccgaagaatactgggaagtccacgccgatctcggcaccgccaagggcgccaacgtgcgcttcgaagtggcccgggaaaaaggcgaggctttcaagccgctgaacgaagcccaggccatggccgcgctggaaaagctcaaggcttccagctacagcatcgtcaagcgcgaagacaaaccgaccagcagcaagccgtcggcgcctttcatcacctccaccctgcaacaggccgcgagcaaccgcctgggtttcggggtgaagaaaaccatgatgatggcccagcgtctgtacgaagccggctacatcacttatatgcgtaccgactccaccaacctgtcgcaagacgcggtggcgatggcgcgcacctatattgaaagcgaattcggcaagaagtacctgccggagaagcccaacgtctacagcagcaaagagggcgcccaggaggctcacgaagcgattcgtccctctgatgccaacaccgagccctccaagctgagcggcatggagcgcgacgctgagcgcctctacgagctgatctggcgccagttcctggcctgccagatgctgccggcgcaatacctgtctaccactgtcagtgtgggcgctggcgacttcgagctgcgtgccaagggccgtatcctcaagttcgacggctacacccgcgtcatgccgcaaatcgccaagccaggcgatgacgacgtgctgccagacatggcccagggcgatacgttgaagctgatcaagctcgacccgtcccagcacttcaccaagccgccggcgcgctattcggaagccagcctggtgaaggagatggaaaaacgcggtatcggtcgcccgtcgacctatgcggcaatcatctccaccatccaggatcgtggctacgtcgctctgcacaaccgtcgtttctattcggaaaagatgggcgacatcgttaccgagcgcctgtcggagagcttctccaacctgatggactacggtttcaccgccggcatggaagagaacctcgacgacgtggcccagggcgagcgcgactggaaaaacgtgctcgacgagttctatggcgacttcaagaaaaaactcgaagtggctgaaagccctgagagcggcatgcgtgccaaccagccggtaatgaccgacatcccgtgcctgacctgtggccgtccgatgcagattcgtactgcgtccaccggcgtgttcctcggttgctcgggctacagcctgccgccgaaagagcgctgcaaggcgaccgtcaacctggtgccaggtgatgagatcgcggccgatgacgagggcgaatccgagtcgctggtgttgcgtggcaagcaccgctgcccgatctgcagcacggcgatggacgcctacctgctggacgagaagcacaagctgcacatctgcggtaacaacccggactgcaatggctacgagattgaagagggcacttaccgcatcaagggctacgaaggcccgagcctggaatgcgacaagtgcggcagcgagatgcagctcaagaccggtcgtttcggcaagttcttcggctgcaccaaccctacgtgcaagaacacccgaaaactgctgaaaagtggtgacgcggcgccgccgaagatggacccggtgaagatgcctgagctcaagtgcgagaaggtcaacgacacctacatcctgcgtgacggtgcttcgggcctgttcctggcggccagccagttcccgaaaaaccgcgagacccgtgcgccgctggtgatggaaatcgtaccgcacaaggacgagatcgatcccaagtaccacttcctgtgtgaagcgccgaagaaggacccggatggtcgtccagccgtgatccgctacagccgcaagaccaaggagcagtacgtgcagaccgaagtggacggcaagcctactggctggaaagcgttctacgacggtggcaagtggaaggtcgaggacaagcgccagggcgcttgatccgctagtctgttaacgccaaaagccgtctgtatagacggtttttgcttactgtaggagcgagcttgctcgcgaagatcgttagttaaacgcgggaagcctggcaccctgccgtgccgggaggtttttcgcgagcaagctcgctcctacacagccagcatcacgcctattcgttgtggagattgccgtcatggccaacgaactctatacccgtaccaatcagaaaatttacttcgcgggtttgtccttggaggcccttggccgtgccgaggaagggaaggagatgaacgccatcgcgctggtccaggcggggcgcgaggcggccttgttccatctgtatggcgctttgctgggtttgtgtcatgaaatcgccgggttctatcgcttgccccaggccggctcgcccagagcggaaatgatcatgaatcacgaagtgctggaatccatggcgatccctgagttggcagagctggtggaaatgacccagagccctgacagttgggtggcgcggttgctcaaggcgcatgcagatatgtttcagccgccgcgtattcctcatgtgcccaaaggcgatgtcacccagccgctgatcgttgccgtggcgttggaacaggatgagcccaagcccctgagccgcgaagagttggaaagctggcgccaggagctgaaaaagatggcgctgcggtttcgtgagggtttgaacgagtgctgaaagtgggcacttgcccggcaccattcatcacgcggtaaagaaacctgcccagttaccctgcgaggctgggtggatgactgatataatcccggcctttcgtggagaacagacttttatgccaacgtcctttctggaaattgttgaactgcctgatggccgaatcgaactgcgccgagctgaggacgaaggttctctagtcattctggatttctccgaagatgccaaagtgttcctgcagggtcagcatgtggaagtggccaaggccatgttgagcgtgggcgtgcagatggcaggtcgcctggcggaaggcgagcctgagaaagacgacggcccgcgggttcttcactgagccccgataacaagctcgctcgccaccacaagcccctctatcccaagcgaatattcaagctctgtgcatcacctgtgcgtgcggcactgatcagttgctgcttggcgctggcattcagcggattcaaccaactcaccaccgtatgactacgacccaggcgcaaggcttcgcaggtcagctgttgggcgctctgcgttccgcgtggttgcagcaacaggatgcgctcgcggttgaggccggcctcccgcagccaggcctgcgtcaggctggcgggcggggcgatcagcgtcagccagcgtgcgtccttgtcttcgctcaaatcgcgcagaatgggagccagcaggttcaggcagctctcagccgcaccgcgcaacgacaattcactgaatgcctcgggctcgccgccccagggggcctcgaccgtttccttgaggatgggcgcaaggggttgggccatgaaggcctcgaacagcgacagttgggcgtgttgtggggtgtgcacgagctgcatgatgcctcctttagcggcgaatgacgccgacactcaagccttcgatcaccaggtcctggtctttcaggttgacttcgatcggggcaaactcagggttctcagccagcagccaaaccttgctgccttcacgcttgaagcgtttgacggtgacttcgtcgccgatacgggccacgacgatctggccattgcgggcttcgcgggtggtgtggacggccagcaggtcgccgtcaaagatgcccacgtccttcatgctcatgccgtgcacgcgcagcaggtagtcggcccgaggatggaagaacgtcgggttgatgttgcaggattcctcgacgtgctgctgcgccaggatcggcgcaccggcggcgacgcgaccgatgatcggcaatgtcgattcgtcggccttggcttcgaagccagggatgcgaataccccgcgaggcacccggggtcatctcgatcgcgcccttgcgggcgagggccttgagatgctcttctgcggcgttcggggacttgaaccccagctccagggcaatctccgcacgggtcggcgggtaaccattgtcatcaaggcagcgcttgataaaagccagaatctcagcttggcgtggcgtcagttttagcatgttgatcgctctgtctttttatacagtgactgggattatatacagtgaactgcgcttggcaatcatccttttcatcggctccgctggacggtcattcgtcacccttcctacagcccaggaatagtgctgcctacagagcgcgaaggatgtgattaaatagccatgcaagtgatgactgcccggccggaaaacgaacctccaggcttgacaagacacactctgaaacgtatgtttcaaacaagtgtttgtcaggcggagtagccatggcccagtcggaaaccgttgaacgcattctcgatgctgccgagcagttgttcgcggaaaaaggatttgctgaaacctcactgcggctgatcaccagcaaggctggggtcaaccttgccgccgtgaactaccatttcggttcaaaaaaagccctgatccaagccgtgttctcacgcttcctggggccgttctgcgccagtctcgatcgtgagctggagcgccgtcaggccaaggccgatcacaagccgagcctggaagacctgctggaaatcctcgttgagcaagcgttggtcgtgcagccacgcagcggcaatgacctgtcgatcttcatgcgcctgctgggcctggcattcagccagagccagggccacctgcgccgttatctggaagacatgtacggcaaggtattccgtcgctacatgctgcttgtcaacgaagccgccccgcgtattccgcctatcgaactgttctggcgcgtgcatttcatgctcggcgctgcagccttcagcatgtccggtatcaaggctttgcgggcgattgccgagaccgatttcggggtgaacacctccatcgagcaggtgatgcgcctgatggtgccgtttctcgcggccggcatgcgcgccgaaaccggcgtcaccgacccggccatggccgctgcccagttgcgtccacgcagcaagaacgcgccgaccgccgccaaggtttgaccgcccccgggtgtgcgcggccgcttgcatccgctaagctagccgccatgccgatttcagctatctactcgcaacccgtcgtgcttaccttgcccggtaagggcggtgggctgtgtgcgttatttaaggaaggtttatgactgctgccctgcaaggttctttgatggtcgacgtggctggtacctggctgacggccgaggaccgccatctgttgcgccaaccggaagtgggcggcctgatcatttttgcgcgcaatatcgagcacccacgccaggttcgcgagttgagcgcggcaatccgtgcggtgcgcccggacctgctgctggcggtcgaccaggaaggcgggcgcgtacagcgcctgcgccagggcttcgtgcgcttgccggccatgcgtgcgctggccgataaccccaacgctgaatacctggcagaacagtgcggctggatcatggccaccgaagtactggctgtgggtctcgacttgagtttcgccccggtgctggacctggattaccaacgcagcgctgtggtcggcactcgctccttcgaaggcgaccccgagcgcgccgccgtactggccggtgcctttatccgcggcatgaacagcgccggcatggccgccaccggcaaacacttccctggccacggttgggccgaggccgattcccacgtcgccattcccaatgacgagcgcagcctggaacaaatccgcgccaatgacctggtgcccttcgcacgcttgagcaagcaattggccgcagtgatgcccgcgcacgtgatctacccgcaggtggacagccagcccgccggcttctcgcgccgctggttgcaggacattctgcgcggcgagttgcagttcgacggggtgattttcagtgatgacctgtccatggcgggcgcccatgtggtcggcgatgcggcgagtcggatcgaggcggcgctgacggcgggttgtgatatgggtctggtgtgcaatgaccgtgcggctgccgagctggcactcaccgccgcgcagcggatgaaggtcacgccgtcggcgcggattgcgcgtatgcgtgggcaggcggttgcgtcgactgattacaaacaggatccgcgctggttgacggctctcacagcgttgcgggacgctcagttgattgagtgaacggcgcctgtgctgttaagaagcttggtgtaagaagcgtctgaatatggctgtagctatctcttaccgccttgtaggagtcgccctgctttaaatctcgttgctgaccgctgtagagttctgctccatgaatgacctgattgcacgtatcgtcgagttggattggcaggaatactttgaccctcgctcgctggagcgtggctttgagtatgctggcgaaaatcgtcttgagataaaagaattcggacagggcagactgattgcacagtgcaaggggtctggccgtaatgtctataacctggtgattaccctggagggtgcagcatcacgttggacgggcatcaggtgcgtgtgttcttgcccggtggctatcaattgcaagcacgccgctgcaaccttgtttacgttgaccgcgctgtatgacgagctgaacgaaccgaaaaaacaggtggctgaccgtctgaatccgcagctcgaaaactggcttgagagtatccccaagcccgctcctgtagatgaggtacaacacaagaacactggtacctgtttgctgtatcaactcgcccccgatgcttattcaatgaggtggtcactagaggtatatcgggcacgcgtgacgaagaaaggtgactacagcgatatcaagccgctgcactcgatggatgaaatattgcggcgtactcccgcttatatgcatgagctggatataaagcttggtcgcttgctcatgttgagccgtccttacctaagctacggcagcgcttttcagttaacgggtgaggcgggcgccgaaatactccagctggcgttgaaaacccagcgtctgttttttgatttggatgctgggttagcgcttaacccagggcctgtccgtgccgctcgtttcaattgggccgtgatgcctgatggcaattattgtcctgaatggctcagcaatggtcgtgaactggacgaagtattgcctctcaagccgctccattatctggacttgggcaacatgcagttgggcgtgcttgagcctggggtggatgagaacctggcgatacatttatgtggcctgcccgtgattccagctgatcaggtggcgatgttcagtcatcggctcagtgtggtgtcccaagtcattcctccgccacgtgagctgaccgagcgcgtcgtggatacgctggaaccacaaggctgcctcaccttgggaagcgacgaatcctacgtctacagccagaccgactatcgacgaatgcccttcctggaacaccgcgctgccttggctttccgttacgacaccagcctggtcagcggcaagggcactgaagacatcctgtttctcaacggcaccgaaacccagcgcattcaacgcaagccggcgtctgaaaaagccctgcgcaagacgctcacaaaaatcggcttcaaaacggtcaatcgtaaaacccgtgcgctgcctgccagtgcaggagagatgttcgatctacccaatgatgaagcctggctggcgtttgttgagagcgggctgtcggttttgcgtgaggcagggtgggacgtcgtcatccatccggggttttattacgatgtggaggctgtagacggctggtacgcggacatcgaagagtcgcccggccacgagtggtttgaccttgagctgggcattgaggtcaacggcgagcgtcacagcctgctgccaatcgtacttgacttgatgcgtcgtcaacccaaactgcttgacgccgcctacatggccgagcgtgatgatcaggagcgcgtgttggtcagtctgggcacccgcactcataccaaagtcgcgctgccctacggtcgtatcaaacccctgatggcgaccctcggcgaactctacctgcgtgcaccagaaggcgatgcgctgcggctgagtgcgccggatgcggcacggctcagtaatctggatgcactacccttggtctggcagggcggcgagcgactgcgtgatttcgccaagcgccttaaagactccattcacgttcatgtgccggctcctcggggcctgaacgccgaactgcgcggctatcagctcgaagggctgaactggatgcaaaccctgcgcgagctggaagtcggcgggatcctgggtgacgacatggggcttggcaaaaccctgcaggcgctcgcccatctactctgcgaaaagcagtctggccgtttacaggcgcctgcactggcggtaatgcccaccagcttgatcccgaactggatggacgaagctgcgcgttttacgccacagctcaaagtcctggcactgcacggtgcgcagcgtcaggctgacttcacgcgcttgaccgattacgacctggtactcaccacctatgcactgttgccgcgggaccttgaagtcctgcagcctcagcgctggagcgtgctgatcctggacgaagcgcaaaacatcaagaaccccaacagcaaagcggcccaggctgctcgtcagttggaggccggtcagcgtttatgcttgagcggtacgcctttggaaaaccacttgggtgagctgtggtcgctgttccacttcctgttaccgggctggttgggcgacagcaaaacctttaatcgtgattaccgtacgcccatcgagaaacacggtaatgcgcagcgtatgcagcacctcagcgcgcgtatcaaaccgttcctgttgcgacgtaaaaaggagcaggtcgcgacggaattaccgcccaagtccgaaatcgtccactgggtcgagctgagcgacgcacagcgggatgtctacgaaacggtacgcgtggcgatggacaaaaaggtgcgcgacgaaatcagtcggcatggcgtggcccgtagccaaatcatcattctcgaagcactgctcaaactgcgccaggtgtgctgtgacttgcgcctggtcaaatctgcgccggtgactaaagctgtcaaggccggcactggcaagttgggcagcctgatggagatgctggaagagttactcagcgaggggcggcggattttgttgttctcgcaattcacctcgatgctggcgttgattgaagaagagctcaagcagcgtgggcttgagtattcgatcctgacgggagacacccttgaccgacgtacgccagtgaagaacttccaggacggcaagacaccattattcctgatcagcctgaaagcgggcggtacgggcttgaacctgacggcggccgatacggtgattcattacgatccgtggtggaaccctgccgtggagagtcaggccaccgaccgggcttatcgtataggccaggataagccggtgtttgtgtacaagatgattgcccggggcacggtcgaggagaagattcaggcgttacagttggagaaggctgcattggctgatggagtgctggaaggtggcgccggtgcgggttggaagctggagcagagggatattgaggcgctgtttgcggccttgcctggctaagcaccacggcgcacccatcgggggcaagtcccctcacacactttgaattgtaaatacatacaaatgtgggaggggtcttgcccccgatggcgatggaacagtcagcgcttttcttgcttgttgggcaacggcgcaaacaacgcctcaatatcttcattgcccaactgccaatctccagtcgtacgcccatccagcacgcccgccgccaagtcggacttctccttctgcaggtgctggattttctcctccaccgtgccccgcgcaatcatcttgtacacaaacactggcttttcctgcccgatgcgatacgcacggtcggtggcctggttttccgtggccgggttccaccacgggtcgtagtgaatcaccgtgtcggcttcggtcaggttcaaacccacgccaccggccttcaagctgatcaaaaagatctgcaacttgccgctctggaaatccttcaccggtgtacgtcggtcacgggtctggccggtcagcaatgcgtaggcaatcccgcgttttttcagttcgatttcgatcaggctcagcatcgaagtgaactgcgagaacagcagaatcctgcggccttcggcaaacagctcgtcgagcatgtccatcaggctgtcgagcttgcccgagctgctgccacgcgccggcagagtggcgtcgttgaccagacgcaggtcgcagcacacttgtcgcagtttgagcagcgcttcaaggatgatgatctggctgcgggccacgcccttgcgggtgatttcgtcgcggacttttttatccatggccagacgcatggtttcgtacacgtcgcgctgggcctcgttgaggtcgacccagtggatgatctcagtcttgggtggcagttcggtcgccacctgttccttggtgcggcgcagcaggaacggtttgatccgaccgttgaggtgctgcaagcgcacgtcactggcgcgtttttcaatcggcacgcggtaatcacggttgaagctcttcacgtcgcccagccaacccggcaacaggaaatggaacagcgaccacagttcacccaggtggttttccaatggcgtgccgctgaggcacaggcgctggcgggcgttcagctcgcgtgcggcctgggcggccttgctggacgggttcttgatgtactgcgcttcatccaggatcaatacatgcaagggcagggcggcgagcgtgtcgatgtccttgggcagcagggcataagtggtcagcagcaggtcgtagtcgtgcaggttggcgaagtgtttcttgcgccctgcgccgtacagcgcctgcacccgcagttgcggggtgaagtgcgcagcttcatcgagccagttcggaatcagactggtgggcatcacgaccatgcagggccgatcaaggcgcccggcgattttctcggtgagaatatgcgccagggtttgcagggttttgcccaggcccatatcgtccgcgagaatcccgcccacttccagctgtcgcagtgactgcatccagctcaagccttccagttgataggggcgcaaggttgcgttcaggccctcgggcgcgacgcaggtgaagtccttgatgtcccgcaggcgttgggcgaagttgcggatcttctcgccgccttcccattgcaacggcaggtcttccagcgggttgagcctgatcgcgtcggccttggccaggcgcaacgtcgtggtgccggtttcctgcaggtagaactcgccgagagtcgccagcaccggcttcaagcgcccgtagggcagcgccacttgcagcgggccgtggccgttgggcagcccgggaatattcaccaggatcagttcatcatcgcggcgccttgcgagtttttccgggttgaggatctcggtgtgggagcgcatcaggttcaacaggatcggcagcaggctcaaccgctcgccattgacgatgatgcccaactccaggtcgaaccagtcacgctcgggcgcttcatcgacgctggcgtaccagtcgtccaccgggctcaggtcgaaaccgaagtcttcatcaatttgcagctcccagccctcggcccgcagcgtcggcgatgagttgagcgtgaagttcagccaggcgctgtcattgaccatctcgaacagctcgccggcactttccggcagggctttgctctgtcgcgtggcgatcttgaagccgagcaggcgcagttgctcgcgatagggttgttccagctcgggatggcgcttgattcgcaggctctgggtgtcctggcgcacgatgatatcggcgttcttttgcccactgacgtaattgcccaggtagttgaacgacagcgccgcacggtgctggatatagcgctgcatcttgccgttgcgcggttcgaacgcgctgaactcgacgctggccagccacaggcgcggcacgggccgcacgtcctccatgaccacctgcggcaggaccacgcggttatccagcacggcctggagtttttccagcagttgcgcatcctgggttgccgccgggtaggccagggtttcctgaaccttgagcagcaccgccgcgatgtgtttgcagttggtgtgcaccgggcaggtacagcggctatccaccaggatcagcaggcccttggccgactcacgcaacgagatggtttgccgatagacgttaccgccggagccttcgcaactggcggtaatggtgctgtcaccgcactcgacgatacgcacgcggttttccagtgcgtaacgccgcccgcgctccaggctctgctctttgaagcgattggcccacgaaggggccaggggtttggtcagaggcgaagtgaggggcatggcgctggatcagtcctgcatgtcgggcggtggtgcgctgggcggcttggcggtcagcgaggtgatcttgatcaacaacgccaggtggccgccgtccaggtaattaagctggttgttcttggtgcgtacgtctttctgcgccaggtgttcactggcgatcacgctgccgttgccgtcgaactggttgatccagaaatcggcatcgatgtcggtgaaacgacccaattgcaggctcaacacaccctcgataggaaactggccgaattgctcctggccgtcggtgatcgcgatctttaccggctgctcgcccagattctgttcccaggccttgtgcgcgagcacggtgtagttggagtcggcgcgcaatttttcgacgatgttgcccaggcgcggcgggctcagccgctcgcccaggcgctgggcgccgccatcccagttttccggggcggcgcggctgttgatcaccggctccgcattctggcgcaccaggatcatttccacctggtacgggctgtcggcaaatgccgaaggcgcgagtaccaccaacaacaggctcagaatgcggaacaggcgcatggcggcgtccttcaaggggatttcggaaggaggcgctcaaacagcgcctccagggtattgaagcgttcttcggcacgttccatcggcaccatgaacttgaacagcgtagccccttcgaacttgtagcggttgggctggccctggatcagcttgatcagcaccaagggggctaccggcgtctgcgcttcgaattcgatacgcccaccttgcggcccggcgtcgaccttcttgatccccaactgctcggcctgcaacttgagcagggtcaggcgcaccaggttcttggtcggttccggcagcagaccgaagcggtcgatcatttccacttgcaggtccttgagaccttcttcgtcaatcgccgaggcaatgcgcttgtacaggatcagccgtgcatgcacatccggcaggtagtcttcgggaatcaacgccggcaggcgcaggttgatctccgggccgccgcccaggggttggtcgaggttcggttgctcgcccttgcggatggctttcactgcgcgttcgagcatctccatatacaaggtgaagccgactgcctggatctggccgctctggccatcaccgagcagttcgccggcgccacggatttccaggtcgttggtggccaatacaaagccggcacccaggtcctgggtgttggcgatcgcttccaggcgcttttccgcatcggaggtgatctgttggcgcggcggtgtgagcaggtaggcatacgcctggtggtgactgcgcccgacgcgcccgcgcagctggtgcagctgggccaggccgaacttgtcggcacgctcgatgatgatggtgttggcgctcggcacgtcgatgccggtctcgatgatggtcgaggcgatcagcacgttgaagcgcttgtggtagaagtcgctcatcacctgctcgagttcgcgctcgcgcatctgcccgtggccgatggcgatgcgtgcttcgggcaccagctcggcgaggtcggcggcacatttctcgatggtcttcacatcgttgtgcaggtagtaaacctggccgccacgcagcagttcgcgcagcagtgcttccttgaccgtgctcttgttctgttccatcacaaaggtgcgcaccgacaggcgacgcgccggcggcgtagcgatgatcgacaggtcgcgcatgcccgacaccgccatgttcagcgtgcgcggaatcggcgtggcggtcagggtaagaatgtcgacttcactgcgcagggccttgagctgttctttctgacgcacaccgaagcggtgttcttcgtcgatgattaccaggcccagattcttgatcttcacatcgtccgacagcagcttgtgagtgccgatgacgatatcgatcttgccctcggccaaatcggcgatggcggcgtttacttccttggcggacttgaagcggctcatcacctccacggtcaccggccagtcggcaaagcggtcgcggaagctgttgtagtgctgctgggcgagcagggtagtgggcaccaggatcgccacttgcttgccgccgtgtaccgcaatgaaggctgcgcgcatggccacttcggttttgccgaagcccacgtcgccacacaccaggcggtccatcggcttgggcgcgagcatgtcggcgcgcaccgcttcgatggtggtctgctggtccggggtttcttcgaaggcgaagccggcgctgaaggtggcgtagtcggctttcgggtcggcgaaggcatagccttcgcgggccgcgcggcgggcatagatgtcgagcaactcggcagccacgtcgcgcacctgttcggcagccttgcgcttggctttctgccaggtctcggagcccaggcggtgcagcggtgccagggcgtcgtcgctgccggtgtagcgggcgatcaggtgcaggctggccaccggcacgtagagcttggcgccttcggcgtattccatggtgaggaattcggcggcctggttgtcgatctccagggtctgcaagcccaggtagcgaccgacgccgtggtcgatatgcaccaccggcgcgccttcgcgcagttcggtgaggttcttgatcaccgcatcattgttggcgtctgcgcgcttctcacggcgacggcgctgcatcacacgctggccgaacagcgggctttcggcgatcaaggcaagggccgggtcgtccagcaacaagccctcgtccaacggcgcgatggtgatcgccaggcgctctttgctatttacaaaatccggccagctgtcgaccgtcttcggccgcagtttcaggcgttccaatagctccaacagcacttcgcggcgcccggcggactcggcggtgaagagcacgcgaccggggaagtcgccaaggaaattggacagcgcttccagcggctgggttgccttggcctggatcgccaggtccggcagcatccccgccgggaagcgctcacggccactgccggcgtccacatcctgctggctggcaactacacgcggccagtttttcagacgggcgaagcagtcttccaccggcaggaacagttctgcgggcggcaataaaggccgagacggatcgacgcggcgctcttcatagcggttgcgcacgtcgttccagaagttttccgccgcctgctcgatacccggcaacgagaacacctgggtgtcctggggcaggtagtcgaagagggtggaggtttcgtcgaagaacaatggcaggtagtactcgatacccgctggggtaatcccgctgcttaagtcctggaagattgggcagcgacggaagtccacgtcaaagcgttcacgaaagcgcgccttgaagcgcgtcaccgcatctttttgcagcgggaattcccgcgccggcagcagcttgatcgagtcgaccttgtcgatggagcgctggttttccggatcgaaggtgcgcaaggtctcgatttcgtcatcgaacaggtcgatgcgatacggcaacttactgcccatcgggaacaggtcgatcagggcgccgcgcactgcgaactcaccgtgctcgtacaccgtgtcgacgcagcggtagccgctggcttccaggcgcgtgcgcatctgttctacgtcgagcttctggccgatatccagcaccagactgctgccgagcaggaacttggtcggcgccaggcggtgcagcgccgtggtgatcggcaccaccagcacgccgtgggccagttccggtaggcggtacaggctggcgatgcgctgggagatgatgtcctggtgcggcgagaacaggtcgtagggcagggtttcccagtcgggaaaatgcagcaccggcaaatcaggggcgaagaagctcagctcctgctccaaccgttcggcactttggctgtcggcggtaagcagcagggtaaagcgcttggctgcgctggcagcctcggctatggccaggctcagggcggcaccgggcaggttgccccagtgctgtttacctgccgcggcagggagaagcggtagacgcagaacgggcacggaaggttgagctccaagcgttgcgacaaagtcggtaattgtaacggcccgaggtgccgcctgtcagttgctgactgtgcctattacggtttgtaggaaatgtagtggctaagacaaacaatgccgggttttgactcaatatgtagtgccaaaaagcgcgaatgtttaggagggttacggacaagtcgccccggctgctcaactagtggccttctggaacccgcgtatttcctgggctgtagcgtggtggtatttttttgcaagggctttttgttgcccctcgcgcattgctcatcgtgcagtcgggcgacataatgtagccccttttttcagcccctacatgtggaaggttcccgtgactcagaagcccgaccagtgtcttggtgaatggatcgaccgtgaagcactcgcagaagcgatgattccgcttatcggccagctgtaccgcaataacaatgtggtgagctcgatctatggccgcagcctgatcaaccagtctgtcatcgcgattctcaaggcgcaccgctttgcgcgccatcgctccgccgacgacagcgaactctccgtccacgaaacattcccactgctcaaggccatgagcgagctcaagctcggcgcggcctcggtagacctgggcaagctggcctacaagttccgcaaggaaggcgccggccgtagcgccgagcagttcgtgcgtgaagaaatggccgatgtggttggccagcaaaacgccgcacctcgcaagggcaccgacgtggtgctgtacggcttcgggcgtatcggccgcctactggcgcgcatcctgatcgagaaaaccggtggcggcgacggcctgcgcctgcgtgccatcgtggtgcgcaaaggcgccgagaatgacctgaccaaacgcgccagcctgctgcgtcgcgattcggtacatggttcgttcaacggcaccatcaccatcgatgaagaaaacaacaccatcactgccaacggtaacctgattcaggtgatctacgctaagaacccgactgaggtggattacacccagtacggcatccaggacgccctgctggtggacaacaccggtgtatggcgtgatgccgagggcctgggccagcacctggcttgcccgggtatcgaccgcgttgtgctgaccgcgcctggcaaaggcaagctcaagaacatcgtgcacggtatcaaccacgctgaaatcaccgctgacgacaagatagtgtccgccgcttcctgcaccaccaacgccatcgtgccggtgctcaaagctgtgaatgacaagttcggtatcgttaacggccacgttgaaaccgttcactcctacaccaacgaccagaacctgatcgacaacttccacaagggcgatcgccgtggtcgcagcgccgcgttgaacatggtgatcaccgagaccggtgctgccaccgctgctgccaaggccctgcctgaactggccggcaagctgaccggtaacgcgatccgcgtgccgacgccgaacgtgtcgatggccattctcaacctgaaccttgagaaagccgccacccgtgaagagatgaacgaatacctgcgctacatggcgctgcactccgatctgcacaagcaaatcgacttcgtcaattcccaggaagtggtctccaccgacttcgttggttcgcgccacgccggtgtggtggacgccgaggcgaccatcacccaggacaaccgcgttgtgctgtacgtgtggtacgacaacgagttcggctacagctgccaggtggttcgcgtgatggaagacatggctggggtcaacccgcctgcgtttccgcgctaagccttagcgctgaatgaaaacgccccgacttattcggggcgtttttgtgtctggcatatgtggacctgtaggagcgagcttgctcgcgaaaaccatcaacgataacgcagcgctctggtttaacgcgtggtactcaggtttttcgcgagcaagctcgctcctacagtggagggtgtgtatcagtgattgaggagctcgtcgcttaaactatcggagaaaaaaatagttgtcgcatactggctcatcctgaattcggcgctgatttgcgtcctgtagtatggcaagactggcctacgacgcgaccaagggttaatgttcgccgcgctcggccttctatagactgtgccccggttcacacacttgagccaaattgtccttcatgaccgctggccgcggcatgatttagcccggcgtccaaccgtacgcctggcctgttctgaggagtacgcatggctgtctacaactatgacgtggtggtactgggttccggcccagctggagaaggtgcggcgatgaacgctgccaaagcagggcgcaaggtggcgatggtcgatagccgtcgccaggtcggcggcaactgcacccacctgggtaccatcccgtccaaggcgttgcgtcactccgtgcgccagatcatgcagttcaacaccaacccgatgttccgggccattggcgagccacgttggttctcgttcccggacgtattgaaaagcgccgaaaaagtcatctccaagcaagtcgcctcgcgcaccggctattacgcccgtaaccgcgtcgacctgttcttcggcaccggcagcttcgccgacgagcaaaccgtcgaagtggtctgcgccaatggcgtggtcgagaaactggtggccaagcacatcatcattgccaccggttcgcgcccgtatcgcccggcggacatcgatttccaccacccgcgtatctacgatagcgacaccatcctcagcctgggccacaccccgcgcaaactgatcatctatggcgccggcgtgatcggctgtgaatacgcatcgatcttcagcggcctgggtgtgttggtggagctggtagacaaccgtgaccagttgctcagcttcctcgattcggaaatttcccaggcgttgagctaccacttcagcaacaacaacatcaccgtgcgtcacaacgaagagtacgagcgggtcgaaggcctggacaacggggtgatcctgcacctcaagtccggcaagaagatcaaggccgacgccttgctgtggtgtaacggccgtaccggcaacaccgacaagctgggcatggaaaacatcggggtcaaggtcaacagccggggccagatcgaggtggacgagaactaccgcacgtgcgtgaccaacatctacggcgccggtgacgtgatcggctggccgagcctggccagcgccgcccatgaccagggccgttcggccgccggcagcatcgtcgacaatggcagctggcgctacgtgaacgatgtgccgaccgggatctacacgattcccgagatcagctccatcggcaagaacgagcacgaactgaccaaggccaaggtgccttacgaagtcggcaaggcgttcttcaagagcatggcacgtgcgcagatcgccggtgagccgcaaggcatgctgaagattctgttccaccgtgaaaccctggaggtcctcggcgtgcattgcttcggctaccaggcgtcggagatcgtgcacatcggccaggcgatcatgagccagccgggtgatctcaacaccctcaagtatttcgtcaacaccacgttcaactacccgaccatggccgaagcctatcgggtagccgcctacgacggcctcaaccggcttttttgagcggctccggccggtggcctgagccggccggggagaccgatttcagtaattcccgagggtggcagtggccaaaccgggaaagtctgtaatcaggctatctacgccgaagtcggcgagcctgcgcatcagcgcgggttcgttgactgtccacacggacacgtgcaggccctggcgctgggctttttccagccgctcaggggtgcacagcgtccagttcaacgccaaatattcacagccatagttctgcgcgaccttcaacgggtcgagccaggcatattcggcgacgaggccacgtgacaggtccggggtgagttcgaccgccgccttgagcacttcccgcgagcttgacgtcacggtgaccttgtccatcaggccaaaacgcacggccatttcacggattgccagcacggtggtggcagcacgggtgcgcgaggcgcttttgacttccagttgccagtgatcgaagtcgcacttttcgaacagctcctccaaccgcgggatcgggcatggggtgacccagcccgggccgcctttgcgggcgtccattttcaccaggtcggccgccgagtactcgacgactttgccgcgccggtcggcggtgcgcttgagggtcgggtcgtggatgaccatcagctcgccgtccatggacaggtgcaaatccagttcgcaacggcgcacgccgtgcttgaggcactcctgaaagctggtcagggtgttttccggtgcttcgcctttggcaccgcggtggccgtagatcagggtcacagttgctcctttgcgccaggtgagctggcggggtcatacgaattcaggtgtcttgggcgtcgctttgttcccgtgccaggcgccgttcctgcgcctgtttctgcaggatgtagcgcgccagcaactggcgttgggcatcggtcatggattcgaattccgtgcccacatcaaagctgtcgcccttgggatcgcaatgggtcaccctcgcgcgcagcaacaggccgagcgcctggggcatcagcaccagcttgactgccaggtgggtgtcgggtgccagcggggtagggtgctggaagtcgatgccgccctcggaaaggatcaccggttgcggcgcgcctacttcattgagcaggccgcgggccatgacctggctgagcaggtccaggcgtttgttctgcaccttgaggaacgccgccaggctgcggtctttctcgctgatctggcgcagcaggtgctgggcttcgaattcgctcaggtgcagttcgctgagcaggttgaacagcggcgaatcatccagcaacacttccttgctcgccgcttcggggccagacaatgtgctgatttgaagtgcgatcatgtcgtcgatacggtagtattcgcggcgctcttcttcatctaatgtcgacatggcgaaccccaggttacggtaatggtctgagtgtaaagctgcttaccagaccccgccaccgggacgtcttcttttcctccgaacaagccccgacatgttcagacctctcttcgtatttattggcacgcgttatacccgtgcaaagcgtcgcaatcattttgtgtcgttcatttccttgacctcgatgatcggtctcgccctgggcgtggtcgtgatgatcgtggtgctgtcggtgatgaacggcttcgatcatgagatgcgtacccgcgtgctgggcatggtgccccacgcgaccatcgagggcgatgtgcccatcgatgactggcaaagcctggccgccaaggtcaagcagaaccccaaggtggtggccgttgcgccgtttacccagatgcaggggttgctgaccaacgacggcaaggtgcagaagatcctgctcaatgccatcgacccggcccaggagcgcaacgtctcgatcatcgaccggttcatgctgcagggtaagctcgacgacctggcgcccggcagttttggcatcgtcatcggcgacaaggccgcggccaagctcggcgtgggcgtcggtgacaagctgaccttcgtcgctccggaagtcaccgtgaccccggccggcatgttcccgcgcatgaagcgctttaccgtggttggcaccttccatgtcggcgccggcgagatcgacggttacatcggcctgaccaacctcaccgacctggcccgcctgcatcgctggcagccggaccaggtgcagggcctgcgcctgaagttcaatgacctgttcgatgcgccgcgcggcgcctgggaaatcgcccagcacctgggcgagtcgcagtactatgcccgcgactggacccgcacccacggcaacctgtaccaggccatccgcatggaaaaagccatgatcggcctgctgttgctgctgatcgtggcggttgctgccttcaacatcatttccacgctggtgatggtggtgaacgacaagaagggcgatatcgccatcctgcgcaccctgggcgccacgccggggcagatcatggcgatcttcatggtgcaaggcaccgtgatcggcgtggtcggcaccttgatcggtaccgcggtgggcattctggccgctctgaacgtcagcgccgccatcgccctgcttgaaaaagtgatcggccacaagtttctcaacgctgacgtctacttcatcgattacctgccgtcccaggtgcaaacccaggacgtgctgatggtgggcggcgctgcgttggtcctgagcttccttgccaccctgtatccagcctggcgcgcggcacgtacccagccagcacaggcattacgttatgagtgaatcgggcatgagtgaaaaagcaatcctgagctgccgcaacctgggcaaatcctacgaggaaggcccggagtctgtggtggtgctgtccaacctgcaacttgaactgcacccgggcgagcgcgtggcaatcgtcggcagttcaggttccggcaaaagtaccttgctcaacctgctgggcggcctcgatacgccgtcccagggcagcgtgtggctggccggtgaagagctttcggcgttgaatgaaaaggcccgtgggcaactgcgcaaccgttcgttgggctttgtgtaccagttccaccacctgttgccggaattcaccgccctggaaaacgtgtgcatgccgctgttgatcggcaagaccgcgatccccgaagcgcgccaacgtgccaccgccttgctggagcgcgtcggcctcggccaccgcctggagcacaagccggccgaactgtccggcggcgagcgccagcgtgtggcgattgcccgcgccctggtgaacaacccgggcctggtgatgctcgacgagcctaccggcaacctcgactcccacaccgcccagggcatcaaggacttgatgctggaactgagcacccagatgcgcaccgcgttcctggtggtgacccatgacatgagcatggcccggcagatggaccgcgtgttgcacctgcaggaaggtcacctggtcgccatctgacctgtttcaagcctggcgcctggcgtcgggctttttcattttttcaggcggtgtacgcgaatgttcagaccgttatccattttcatcggcacgcgctatacccgcgccaagcgccgcaaccgttttgtctcgtttatctcgatgacctcgatgatcggcctcgccctgggcgtattggccatgatcgtggtgctctcggtgatgaacggcttccagcgcgaaatgagctcgcgcatcctcggcatggtgccccacgccaccatcgtcggcgtaaagccgattgatgactggaaaccggtggccgccgcggcgatgaagaatccgcaagtcaccgccgccgtacccttcacacagatggacggtatgttctcctacaagggcgccatgcagccgatcgagatcagcggcatcgacccggcccaggaaggcaaggtgtcgatcgtgacccagcacattgtgcgcggcaagctggacgacctgaagcccggtgagttcggcgtggtggtcggcgatatcaccgcacgccgcttccgcctgaatgtgggcgacaagctgaccctgatcgtgccggaactcagcagcgccccaggtggcatcacaccgcgcatgcaacggctgaacgtggtgggtatcttcaaggtgggcgccgagctggatggctccatggcgctgatccacatggccgacgcggcagaaatccagcattggcagcccaaccaggtgcaaagcgtgcgcctggcggtgaaggacttgtacgcagcgccgaccgtctcggcggatatcgccgccagcctgggcgcagcctacaagcccgatgactggactcacacccagggcagcctgttcagcgcgatgaaaatggaaaagaccatgatcggcctgctgttgctgatgatcgtcgccgtggccgcgttcaacatcatcgccaccttgatcatggtggtgaacgacaagggcgcggacatcgcgatcctgcgcaccatcggcgccacgccccggcagatcatggcgatcttcatggtccagggcacggtgattggtgtggtgggcaccctgattggcggggtgctgggggtgatcgcagcgctgaatgtcagtgagctggtgggctggctggagcgggtcagcgggcagcatatcttcagctcggatgtgtacttcgtcagcaacctgccttcggaactgcagggtggggacgtgttgctgatatgttcggcggggtttgtattgagctttttggcaacgatttacccggcgtatcgggcggcgaagattgagccggcccatgcgctgaggtattcgtaaggccttagaccgctatcgggggcttgcccccgatagggccggcccagcttgcgtcaatctcccttgggcaactcaatcacaaacctcgtccagcccgcctgcgactcacaataaatcctccccccatgcgcccgcacaatcgactgggtaatcgccaaccccagccctgcatgttcactgctgcctgcccgccttgacgggtcggctcggtagaaccggtcaaacagccgcggcaataattgcgctggaatgccatccccggtgttctcaaccataagtgtcacgccttcgtccatccgcacccgcacttcaccgcctggtggggtaaaccgcagcgcgttatccagcaagttcgacaaggcccggcgcaacatgccgcgatcgcccagcgtatgggcggtgccttcgcgtaccagcgtgacctgcgcatcctctgccagcagggtaaaaaactccaacagtgcgtcgacctcatcgcccagattcagggcttcacggttgggcatcagcaagccgtggtcggctttggccaggtacagcatgtcgttgaccagttgcgccatccactgcaactcttcgaggttgctgtgcagtgcctcgcggtagtcctccagcgggcgcggttgagtgaggatcacctgggtctgggtcagcagattggagagcggtgtgcgcagttcgtgggcgatatcggcggagaacgccgacaggcgctggaaggcgtcgtccaagcgacccagcatcgcgttgaaggcctgggccagctccgccagctccaccggcatttgcgcctggggcaggcgttgggtcagcgagtgggcggatacgctggcggccacttcgcccatgcgtcgcaacggtcgcagcccgctgcgtgcggcccaggcgccgagcagggcagtggccagggccgagaggccgacggtcagccagatcaaacgctgcatacgctccagaaagtgctgatggtgggtgatatcgaggatcaggctcagctgtggcgagccgggttggccgggcgtcaacggcgcgttgtacacacggtagtcggtgccggcgttttgcaggctgtgcaggcccggtgctgcgggcacgctgaggtacggcgcaccgtccacccagcgctggtcggccgcagtgatacgcaaggtgaagtcgggctggtgatcaagttcggcgcgccattgcgggcctcgcagcgcaaaggcttcccgtgagtcgacaccctgcaaggcactgcgcagggccaccagcttgctgtcgagcagttgctgatccagctcgataaagtgcgcctcgctggcgcggttgaacagcaccccggcaatcaacgagaccaccgccgtgcaggcggcaaacagcagcgcgaggcggctggccagggacaggcgcttgatcacgtgaaccgctcctccagcacataacccatgccgcgcgcggtgtggatcagcttgttggggaagttgtcatcgactttaaggcgcaggcgacggatcgccacttcgatgatgttggtgtcgctgtcgaagttcatgtcccagacctgggaagcgatcagggtcttgggcagcacttcgccctggcggcgtagcagcagttccagcagggcaaattccttggcggtgaggtcaatgcgctggccgtcgcgctcgacccggcggcggatcaggtccaggctcaggtcggccagttgcagggtggtttcctgcggtgtgctgctgccacggcgcaacaaggtgcgtacccgggccagcagttcggaaaaggcgaagggtttgaccaggtaatcgtcggcgcccagttccaggccatgcacgcggtcttccacggcatcgcgagcggtgagaaacagtaccggcatgtccagtccagcactgcgcaccgcctgcaggatctgccagccgtcgcggcccggcagcatcacatcgaggatcaacaagtcatagtcacccgtcagcgccaggtgctggccggtcgtgccgtcggccaccagttcggtggtaaagccagcctcggccaggccctgacgcaggtagtggccggttttgggttggtcttcgacgatcagcagtttcatatcgggctcttggtaaaggatggcagccggcctttataccctgggctccaggggatgggcgcaagctgacaaagttgtaatctagcagtcagctggctggcagcgaggcaatcttaaagtgttgcccaagctggacacctattttttggagagtgaaagatggcgatgcgcacacccctgttattggcgggctgcttgttggcgatgagcttcaatgcgctggcggacgctgctcacacctacgcgttcggccagcccgcaccggcggataaagccacgcgtactgtgcaagtcacgctgcaggacattgcctttgagcccaaggccctggacgtaaaggccggtgaaaccgtgcgtttcgtgctggtcaacaaaggccagttgctacatgaattcaacctgggcgacgcatcgatgcatgccgcccaccagaaagagatgctgcagatgcaagccagtggcatgctcaccgccacaggcatgggcaagatggaccacagcgccatggggcacggcgatatgggcggcatgaagcacgacgatcccaacagtgtcttggtggagccgggcaagactgccgaactgacgtggaccttcaccaaagccacgggcctggagttcgcctgcaacctgccggggcattatcaggcgggcatggtcggcaaactgaccgttgagtgaggcgtttgttaagggcgggggcaaaggctggtagactggcgcggtttatttagccaggtttccgccatgcatcccgcagccgaacattcgccgctgggcaagtccagtgaatacatctccacttacaccccatcgttgctgttcccgattccgcgcgccgccaagtgggccgaactgggcctgagcgccgacaccctgccgtacaagggcgtggatttctggaactgctttgaattgtcctggctgctgccgtcgggcaagccggtggtggccatcggtgagttcagcatcccggccgactcgccgaacatcatcgagtccaagtccttcaagttgtacctcaactcgctgaaccagaccgcctttgtcgatacgccaagcctggaagccaccctgcgcaccgacctcagctttgcagccggcaagccggtgaccgtgcgcatccgcagcctggccgacatcgaggccgaaggcgtgatggcgttgccgggtgcgtgcattgacggcctggatatcaatgtcagcagctatgagcatccgcgcccggagctgctgcgttgcgatgactcgcgtgtggtggaggagagcgtgcacagccacctgctcaaatccaactgcccggtgaccagccagccggattggggcagcgtggtagtggagtaccgtggcgcggcattggatcacgccagcctgctggaatatatcgtgagttttcgccagcactcggacttccatgagcagtgcgtggagcggatcttcctggacttgcagcgcttgctcaagccggagaagctgaccgtttatgcgcgctatgtgcgccggggtgggttggatatcaatccgtaccgcagcactgaaaatacccagttcctgaacgtgcgcctggcgcgccagtaagcctgcataaacaagcaaatgtgggagggggcttgctcccgatagcggagtgtcagtcacggcatctgtgtctgaacttctgctatcgggagcaagccccctcccacattttggttctttatttggcttagggtcgggttagatcccgatattgcccagggtgatcatgatgttgcgcaatgtcccggaaatgaccgggtgctcagcgtcgaactctatggccgcctgattcacatcgtcggagatgctcggcgtctgagtggccggttccaattcaagttgcacttcgaacttggcaatcagttcctccaacgcttcacgtttttccagtgacagcggtggctcctgttccaactgcccgcgcaggatctcgacctgttcttccagctttttgcgatcaggcatgacgttctttccttttatcgatagtcactggcatagaccacggcacgccgcgaaaggtctacgggctgacctgtagattaatccactggggctaaccgtgcatgatcttgatcagggcttctcgcctttgagccggcgcaggctgatgtctgccaggcaactgccgagctcgccgaggtggtcgatcaccgagtgcacgcccaggccatagagcgccacagtcgccttgccgcgcttgtattcgcgttgctgtgcggtcagtgcctgccattgctcgggtgacaggccgcagagcgagccacatgaggccagaccgatggtccacaacccggcattaaggcccgattgcagcaggcgcggctcgccgctgaccagtacgcaaccttccaggcgttcgatgttcagttccatcaaggcttgccagcaggcgtggggcgcgggccagcggatgggggagggcgaggcggccttgacccagcccggcagactggtggacaggggcgtggtaaccgagggcggcagttcgtccagccaggcgcagggcacgcctagttctttcaggctacgcaggcttttcaaagcgccgggtgtggccacggagccggggcagggcgaatcggtacgcgccagggaaccaaaatccaccaggcagccactcaggccaaataacacggcggtcaatgaaggggctgtggcgatagcaatctcggcgtgtggcatctgaacgtccctgaaatagcagcaacactaacggggtggcatgacaaggccatgacactgatggtgtttgtaggaattttgtgcatttttcgtaagacaggatccttgtagctgcctaaacacacacttccgtcatatactgacggccttattcagggcatagcgcccatgacagaccattcaaggagcaaaagctatgcgctggagccactacttcgctcagctgtcggtgtgtgccaccgtgctgttggcacctttcgccgtacaagccgcgtcggaagatgacccatgggaaagcgtcaaccgcccgattttcaccttcaacgacaccgttgatacctacgccctcaagccaatcgcccagggctatcagttcgtcaccccgcaatttgtgcaggacggcgttcacaacttcttccgcaacatcggcgatgtcggcaacctggccaacaacgtgctgcagctcaagccctacaatgctggtgtcgacacggctcgcctgctggtcaacaccacgtttggcgtgctgggctttatcgacgtcggcaccaaaatggggctgcatcgcagcgatgaagacttcggccagaccctcggctactggggcgtcggcagcggtccctacgtgatgatcccgttgctcggcccaagcacgttgcgtgatgcgccgtccaaatacgtcgacagctacacccaaccctaccgctacatgaatgacatcggctggcgtaacagcaccttcggcctgaacgtcgtcgacgtgcgcgccagcttgctcgacagcgagaagctgatcagcggcgacaagtacaccttcattcgtaacgcctacctgcagaaccgtgagttcaaggtcaaggatggcaaggtcgttgacgatttctaggccgtgacgttttgaaatgaaaaaggcgacctttgaaaggtcgccttttttgtgcgcgcttttcagcgcatcttcaagatcctgagacccaagtgctgttcatcgcccgcagccttggtccacacaacttcagtgtctgcctccaggcccttgagtgctgcgtgctctgaatcgatgcgtacggtcagtaggtcgcccacgttaaactggcgcggcgcctgcacctgcatgccggagctggaaaggtccaggcatacaccttcaatctcctgaccggcgtggatcagggacacattggcatccacccgcatgcggatgaaatcgcgtttttcggcgtagtcgcgctcgtgttcgctcacagcatccatccttactttacgttggggttgtggcagttcttataactcccggtgatttgcggtgtaaagacgcccggcgaccatcggcatgagcttgaaacccctcacggatgggagtaccgtctgcgccttagaagggcacctctgctttaccgctgtgcatgggcgaaatcccaatgctttgtaggacagagaggctagaaagcgaatccagtacgtgagcccggccattgccgagccgcctacgccaacctaattctggcgccgtttgcccacatgcaaaaaaccagtgccacgctgctgataatcgatgacgacgaagtagtgcgcgcgagcctcgcggcctacttggaagacagtggcttcagcgtcctgcaggccagtaatggccaacagggtctccaggtattcgagcgcgacaagcccgaccttgtgatctgcgacctgcgcatgccccagatgggcggcctggagctgattcgccaggtgaccgagcttgccccgcaaacgccggtgattgtcgtgtccggtgccggtgtcatgaacgacgccgtcgaagccctgcgcctgggcgctgccgattacctgatcaagcccctggaagacctggccgtgctggagcactcggtgcgccgcgccctggaccgtgcccgcctgctcctggaaaaccagcgctaccgcgaaaagctcgagaccgccaaccgcgaactcgaagccagcctgaacctgctccaggaagaccagaacgccggtcgccaggtgcagatgaacatgctgccggtgagcccctggagcatcgacgagttcaagtttgcccaccagatcatcccatcgttgtacctgtcgggtgattttgtcgattatttccgtgtggatgagcgacgcgtggcgttctacctggccgacgtttccggccatggcgcttcttctgcctttgtgaccgtgttgttgaagttcatgaccacacggctgttgttcgagtccaagcgcaatggcaccttgccggagttcaccccctccgaggtgctgggccacatcaaccggggcctgatcagctgcaagctgggcaagcacgtgacgatggtcggcggcgtgatcgatgaagaaaccggtcttttgacctacagcattggcggccacctgccgatgcctgttttatacactcctgacagtgtgcgctacctggaaggtcgtggcctgcccgtaggcttgttcaatgaagccacctacgaagaccacatcctggaactgccgccgactttcagcctgacgctgatgtccgacggcatcctggaccttttgccagagcctacactcaaagagaaagaagccgccttgccccaaaaggtcaagtcggcgggcggcagcctggatggcctgcggcaggtttttggattggccacgctaggggagatgccggatgatatcgccctattggtgttgagcaggaatctttgatgagtaccggaagaatccaattcgccgagcaagacgggaccttcgtcctcaagtttgtcggcgaagtgcgcctgaccttgtgttcggcgctggatgcgacgattgagcggatcttcacagcgctgaacttctcggcgatcgtgatcgatctgaccgaaacccgcagcatcgacagcaccaccctggggctgttggccaagctgtccattctgtctcggcagaaggtcggcctgttgccgaccgtcgtcaccacccacgaagacatcacccggctgctgcagtccatgggcttcgaccaggtgttcaacattgttgaccgcccgattccctgcccggaatgcctcaccgacctgccgtcgcaagaccagtccgaagagatcgtacgggtcaaggtgctggaagcgcacaagatcctcatgggcctcaacgagtccaaccgcgaagccttccacgacctggtcaacgccctcgagcgccactgacggcttccctgtcgaaacacatacccatgtgggagggggcttgctccctatagcggtggatcagtcaacaaatccagtgactgacactccgctatcgggagcaagctgaactggcctaatgatcccggacacctcttaagggcgatatgattcgcccattcaggaggttccatgcaagaacgaaaaacctatacccgcgagttcaagcaacgtgctgcaagcatggttcttgatgataactgctcagttcccgacgtctgtgcatcgatggaggttggccctacggctctgcgccgttgggttgatcaggttcgtaaagagcgtcagaaagggcagccagtggccggtaccaaggcaatcagcgaagaacagcgagagctgcagcagctgcgagccaaggtcaagcgtctggagaccgaggctgaaatcttaaaaaaggctacggctctcttgatgtcggatcccgatcgtttttcctgatcgaggagctgagggagtcgagttcatatccgacctgcctgctttgcagtgcgctgggcgtttcccgtagcgcgttttacgactggcttaagcgtcgctcagcgcccaataccaagcgtgacgcgctcagagcaaaagtcgtgcaactgcatgacgaaagccggggaagtgcaggcgcgcggatgatctctcagcacttgaaggcccagcaggtcaaggtgggacggcatttggccggaaaactcatggcggaggcaaatctggccagcaggcagcgccgccgccatcaatatcgctctagaggcgtcgaagcatttgtggccaagaacctgcttgagcgtaactttgagccaaccgcaatcaatcaggtctggtgcggcgatgttactagcctgatggttgggaaacgctggtatcacttggcagcggtcattgatctgttcgcccgccgaatcattggctgggcgttttccctgatcaacgacgccaacctggttagcaaggcgctaagaatggcggtggaggttcgaggcaaacatgggggcttgatgtttcattcggatcaaggctgccaatacaccagtcagcgctttcagtccgagctgctggaacatgggataacgcaaagcatgagccgcagaggacagtgctgggacaacgcgccaacagagcgtttcttcgggacactcaagtcagagtgggtgcccaccaagggttatacgacagttgaagaagccaggcaggatatgaccagcttcttcatgcggtataaccgaattaggctccacagctacaataactacctgtctccaatagccatggagcagcaggcggcttgaccaccgtaatcggtgtccggaaaaacttgaccagaacaagccccctcccacaattgacctgcgatcgacttgaaactggtacacaaaaaagggcggcaccctcacaggtgccgccctttttgctgctatctgcccttacagcttggccgacaacaacgcctccagcttctcctgatcccgagcaaactggcgaatgccctcggccagcttctcagtcgccatcgcatcctcgttggactcccaacggaactgcgcttcagtcatatgcacacgggcctcaccggcatggcctggcgccaacttgcgctccagcttgccttcatccgccgccagcttctccagcaggtccgggctgatggtcaggcgatcacacccggccagctcttcaatctggctcaggttacggaagctcgcacccatcaccacagtcttgtagccattggccttgtagtagttgtagatgcgcgtcaccgactgcacgcccgggtcatcggaaccggtgtagtcgttgccgttggccttcttgtaccaatcgtagatacggcccacgaacggcgaaatcaggaacacaccggcttcggcgcaggccacggcctgagcgaaggagaacagcagcgtcaggttggtctgaatgccttctttttccagcttctcggcggcacggatgccttcccaggtagaagcgatcttgatcagcacacggtcacggccaacaccggctttgtcgtacaggtcgatcagacggtgcgcacgcttgagaatggcggcttcgtcaaacgacagacgcgcatccacctcagtggagatacggcccggcaccactttgaggatctcttggcctaccgctaccgcgaaacggtcactggccaggcccacgtcgccgttgcagtcctgcacacactcatccagcagcttggcatagccagagatcgacgcagccttgagcagcagggaagggttggtggtcgcgtcttgcggcttgagcttggcgagggtggaaaaatcgccggtatcggctacgacggtggtgaattgcttgagttgttccagcttggaagtcatgggcgtgctctgtcctgtgggtctgatgacattacccgagcgctggcgggcgctcaagggcgcaaatgcgttaggtcgtttgcgagggcaataacctggaaacggccgtttgaataaccggcagtggtgctcaataggagggcaaaatcgcaggtaggttcaacctgattccacgtgacctgcgccaccggcttctagcgagttgatagaggcaatatcaatgttttgaagttgtgaaaagtttattttccatacctttggttgttgctgtttttgcgtgtgctatacctgactggcaagcgctaacttaggccgataaaaactctgatgacataactgtccgcggcgaagtgcgtgtgcgcctgtccattaagcactgttcgtttgttagtttaaaagcaaaggagagatgtaatgaaacggaatatatcaacgctattcgtcgccctgggttttatttgttcaacaacggtattcgccgacgtgacggtacagcaggcactcagcgccggttgttacgatacccaggaaatgcgtggaatcattgacaccgccaaggcaggtaaacccatggggagccgcactctggaaaaggaaaatgaactgaactcatcctacggcggcaagatcaccgacaccagagtgaccgcgcctgccacctgggtgtaccgcgcgtatgagagcgcagacaccaacaattggcacgtccagaagctcaaggccggagtgatctattccaaggctcagaacgacctggacaaatacctcagggacggtggcacacccgaaaagtactgggccatcgatgggcctgacttgcacgcgctgggttttaacggtgccacctacacgacaatgcgactgctcgcgttacagtccagcgacaccccaaaaagtcagttcgtgagtttcgcactggactacgccaccaccggaacctttggagacgccgtgtatgcacttcaagtgaaccccaactcccccattctggggttggttaactgcaaaacgccaggcggtgaagttcaatttcaaattcttggcggcacaacattcaacacgctttaccgcaaagttagaaccgaaaaagattggaaaaggtataaccgagacaacgaccaatgggtagctgtacccaaaggaacagtgccggaaaattaagcaacagtgcagcaagggccggcagtaactgccgcgcccttgcggtcaccgctaaacctgtgggagctgccctgcgataacgccggtacaccctatgagtatccacctgacacccataaggcaaaatgtgggagcgggcttgctcgcgaaagcggagtgtcagcctccatctaaaccaactgacactcgaccaatcaccgcccctccaacaacgcccccgcctgatccaacaacgccaatggatccgccgccttatgaatatccaccgacaacaactgcctgaacttgcgcgcccccggaaaaccagtgcccaaccccagcacatgccgcgtaatgtgatgcattgtcccaccactggccaaatgctcagcaatataaggccgcaactgcgccaacgcctgcgcccggctaatcaccggcgcctcgctgccaaacaaccgctgatccacctccgccaacagatatggattgtgataagcctcccgccccagcatcaccccatcaaacgtccgcaaatgctcctggcactgctccagcgtcttgatcccaccgttgagattgatctccaactccggaaagtcccgcttcaactgcgccgccacgtcataacgcaacggcggaatgtcccggttttccttgggtgacaacccctccagaatcgcaatccgcgcatgcacggtaaaactggtgcaaccggcatccttcaccgtcccgacaaaatcacacaactcggcataactgtcccggccattgatgccgatacggtgcttcaccgttacagggatcgacaccgcatcgcgcatcgccttcacacaatccgccaccagggcagggtgagccatgaggatcgcgccgatcatgttgttctgtacgcggtcgctggggcagccgacgttcaggttcgcttcgtcgtaaccggcggcctcggccatgcgggcgcaggcggccagatcagccggaacaccgccgcccagctggagcgccagcgggtgctcggcttcgttgtggcgcaggaagcggtcgtggtcgccgtggaggatagcgccggtagtgaccatctcggtgtagagcagggcgtgtttggagagcaggcgtaggaagaaccggcagtggcggtcggtccagtccatcatcggggcgacggagaagcggcgggagagtggggcggtttgtagggacattgggaatctgagtcagcgaggcgaatggcgcgcagtttatcaggaacggatcttgggtgccggagaggcaagttttgcgcgcattaccacttcgagcgaggacgttgccgtgtatggaatacgccaaggatctggagtcgatcaccccgcactctctacgggatcagataggaccagttggggactgcccattcgcgggtatgtttcacccgaccttcgcgccccatggaaggaaactgagccagcctgtcgacgctggcgaaaatggcatccgagaagtcgtcagcggcttttggattttcgagagcgatatagttcgcttcgtcttccaggtttttgagtgctttttccagccactcaacccgcattcctgctccagcgcctagcgcgcatggccgccacttggtcatcagtggcgaatttaccttcgtcggcgtcttttaccgccagctcgatctgagcggtcagcgttttttcgtgctcgatgtagtcgcgaagaacatccatcgccaggtagctcgctgtttggtcgttagttttggccggatcggcgagagagttggacaggtcttccggcaggtttagggatatcccagtcatggcggcctcgatggtggacggttgtggggcatcttacaccgtgaagcgtcgggttgaagcagcaggccgtcgcgaggtgtgtctgggagtgagtcgtttgcttttcctttgccaactcaaaaccttatatcgtggcggataaataaatctgccccttttgtgttcatcccgcctgcgtggctattggctcctccgtaattttgcgactctattgacttttgataggatggagatatttttttcggatgggctattttttaaagtttttgagcttatttgttcaatgactttttctatggcaggtattttttttagtatttcgtcttttgctaggcctcctagttttaaaatcgttgatagaaatggtattgcacaacctgcggtgtcaatgcctaagtctaaggcatgttttatcttgttttttcttgagaaaaaagcttccatttctgaattgtattgaatgattctgagtgctctattttcagtgtttagttgcgctagctctgaaaatagagagttcatcccttttcgaattccagcatgggatatttctttttcgtactcttcgatagagatgtagtcattagtttggaatattgatattaagtcgagtgttgggtttccttgggacttgagtgttgtaatatcattaaagtctttcaaagtttcgtaagtgctatttttgtatagatttagtgtgtttcccataagaagggaataagggtggtctgtatagctgttgtcttcgaggtaaaaggggaagtaggtggcatcaagcgcatgtgctacatgaattttgtcactgtgcacaaggaattcaaactctaatttctccttcaaactactagggagttgatgagttatggttttgtttacgccatatcgtgctatgcccattgggcctgcttcatttaactctgaaaagctagctcgtaaagcatatttgggccaaagtaaatagtcagcaattagttttggattttgccctgtcgctgtggaaagctctgttatgagagggtgtaaattacctagtgtggggtcgcttaatatgtacgagttgttgatggagacaatatcaatcgcacataaagcagctaatgcccgtctacttataacggcattccgcttttcctgataggcttcgtttaaaaagccgtagtccagtcgatgttcaggttggatgtttaggatttttattctgtcttgagagactaaaaataaaatttcattttttgagattttttgatctcttaaaaatgcactcatattttcttttagtggaagtacgcagtacacaatgtcatagagtaatattaaacttctcaggttgcagtttttgaaaagtgtatagttcactaggcatgaagtttttttgctgtcagtgaaatataagtcatcttttgtgaaggagccgctgtagatgttttcaatgttttcaaaccacagcttttcatccctttccagaaattcgcagtttattcccgcagctgccgatgaggggccgataatgaaaacctcgtctgcataaccccgctttgattcattagttccaccagtttttatttcatactgcattacggtttttaaaagattaagtttgtttttgaattgtgttatctgttcttcttgtggattgcccattaatgtgattgttattttgtttttagggaagtctgtctcgaaggaactgatttttagttttgggaatgtgcataggagatggttgtggaattgatctgttgtgaacggtaatccttcaaaatttgacgggattgttttgtcatcaatcggggcgagctttttttcaaagtattctggagtttcccaaatcagttttactggggtggtgataaagcgaatcttgttctcgaaattttcctcaatttcttctttgttttcaatgtgttgatggatttctattaggaaactatttgtttttatcttgtatatggaagttgtgagcgtggggtacattgttcgtaggttgagatctattcttctacaccatccttcatagtccatatgcatattttcctttaattgacatcattgagatgaaagcaagcttctctgaatagtcctacatgctatcgggattgcgttgcttcatccaccccgctaatctcctcaagtcgctgctaacccagtggccggaggtggaagtccgtattgctaaggcgtttttaactcccgtgaacatttggagcttcgcccatgcacaacaacacacgcagttcttcacttgatcaaatcgcatcgtccgtcgatcccaagcttcaagccgcagcccagcgagcaaaccatcatcacttgcccccatccgacgacgctgcgcccgcagaacacccaagcaacaacctattcctcgtaaacccaaccatcgatcccgaaaccctcctagccaacgccgccgaaaacctcgcatccgccaacgaaatggccgccaccttggcgttcgatctcgacgactcccagcgcgccatcgccttgggcattcagcagttaatcgagttgagctcgctgctggttgatcgagcccaggagcaggttgcgcctgtaactgccccagtcaaagcctgacaaccagccccgccgccttaccccaaggcggcaacctgaactcatcctgtcccgctgcaaagtttcataatccgctgcacctttgaggtctacgattccagccaagagaggcctctacgcctcctggcccacagggagctgaaaccatgatctcgaatctcgtcaaagttgtgatgatcaccggcacgttgatgttgagtgcttgttcatcttcaccagccgtgagcagtgacccgtgcttttcaggcggatgccagtcgtttggggaccacagccccagcaaagccgccaagatgaattttggtggcagtgggttggggagtagttatggggagtatggttcggggttgttgcatgatgattgatagggtggtgggtcattcattggtgtgttgattgacccattggccagtcagttaagcgcaaattgccagctcccacattgggtctgcattgctttgagcattgtgttcgcttaactgattggtattaggcgagccgttaatggcctcctttcatccgccgggcgatcaggtagaggcccaggccgaccagggctgtcgcggcgccgatgtagccggtgctggtccagccgaggccagctgtaatcgccatccccccaaaccacggccccagcgcatttgccaggttaaacgccgcatggttcgatgccgccgccaggctcggcgcctcatgtgcaatgtccatcaggcgaatctgcaacggtgccgccaatgcgaccatggtgccaaccaatcccatgctcagcagcacgccccacagtgacgccgcggcgaaggggaagaacagcagcacggccatcgaccacaccaatatcaagcccaccgcccggaactgcatgcgatcaaacagcttgccaccggcaatgttaccgatgatgccgccgacgccgaacgcggcgaggccgaagggaatccactgcggcgagaccttggtcacttccagcatggtcggcgccaggtagctgaatacgcagaacataccggcaaagccaatcgcgccgatggacagggccatccagacctggggtttggtgaaggcgcgcagctccttgcgcgggtcgctgcgttgttcgtcgtggcggtggggcacgaattgccagaccagggcgatggtgagcagggcgatcacgctgaccagggcgaacgccgagcgccagcccaggtgttggccgaggaaggtggcgatggggttgccgagcagcatggccagggtcaggcccatcatcacgcgggctacggcgccggcgcgtttgtcggtgggcaccatgctggaggcaaccacggcggcgatgccgaagtaggcgccgtggggcaggccgctgataaagcggaaggccaccagcgagccgaaggtaggggtgaaggcggtggcgaagttgcccagggcgtacaggcccatcagcaacagcagcatgtgtttgcgcagcagcttggcgccgaggatggccagcagtggagcgccgaccatcacgcccagggcataggcgctgatggcgtggccgacttgcggttcgctcaagcccaggttctgggcgatgtcgggcatcaggcccatgatggcgaattcgccggtgccgatcgcgaaggcgcctacggccatggccgcttccattttcgcggcgctgcgcgcgggcagtacgtgcccgggtgtttgctgggtagtcatgggtaactctatgtggaaggtgtgcacgaaagacagccgccgatgctacgcaggcaacggcgaaggtgtctagaaccgccatttgcgtcagagttccaggcctgtgaccgcaggtcgcggctgtcaggcttgacaccggcgcattaaaagccgcgatttgggcctgtcaattggccaaacggcgcataaacgctgtttagcgtgatattctgcgcgccgtcttggtctaggctttccctggtgcgtacacccgtatacgtcccagcggttggctgttgcccaggtagctgagccaataatgataagaagtcagcgcagaagggacataacagtgaggtcgatccatcggccttgtgtgcccaccctgcagccttcatgtgaatgtgcagaccccgcggtacgttgcctgacgtagcgtgaacgagggttactcatgatcgggggcggtagggcggatggcgttttatcataggtgctactgatgtttaaaaaagtaaacactgccctgctggggctggctttgtcgatggggatcacgtccgttcacgcggaagaggcaaagaaagtcgatgtgctgctgatcggcggcggcatcatgagtgcaaccctgggtgtctggctcaatgagctggaaccggactggtcgatggaaatggtcgagcgcctcgatggcgtggccgaagaaagctccaacggctggaacaacgccggtaccggtcactctgctttggctgagctgaactacaccccggaagacaagaacggcaacgttgagatccctaaagcggtcgagatcaacgaagcgttccagatctcccgtcagttctggtcctggcaggttcagcagggcgtgttgaagaacccgcgttcgttcatcaactccacgccgcacatgagctttgtgtggggcgatgacaacatcaagttcctgaaaaaacgctacgaagccctgcaagcgagcccgctgttcgccggcatgcagtactccgaagacccggcgcagatcgccaagtgggttccgctgatgatggaagggcgtgatccgaagcagaagatcgcggccacctggagcccgatcggtaccgacgtgaacttcggcgagatcacccgccagttcgtcgctcacctgcaaaccacgccgaagtttgacttgaaactgtcgagcgaagtgcaggacatcacccgcaacgacgacggttcgtggcgtgtgagctacaaaaacctgaaagacggcaccaagactgaaaccgacgccaagttcgtgttcatcggcgccggcggcggtgccctgcacctgctgcagaagtcgggcattcctgaagccaaggaatacgcgggcttcccggtgggcggttcgttcctggtcaccgataacccaactatcgccgagcagcatctggccaaggcctacggtaaagcctcggtcggttcgccaccgatgtcggttccgcacctggacacccgcgtgctggatggcaagcgcgtgatcctgtttggcccattcgcgaccttctcgaccaagttcctgaaagaaggctcgtacctggacctgctgaccagcaccaccacccacaacatctggcccatgaccaaagtcggtattcgtgaatacccactggtcgagtacctcgccggccaactgatgctgtcggatgacgaccgcttcaaggcgctgcaagagtacttcccgaacgccaagcagtccgactggcgcctgtggcaagccggccagcgcgtgcagatcatcaagcgtgacgaagagcagggcggcgtgctgaaactcggtaccgaagtggtcagctctgccgacaactccattgccggcctgttgggtgcatcgccaggcgcgtccaccgcggctccgatcatgctgaccgtgctgcaaaaagtcttcaaggacaaagtagcaagcccggcctggcaggaaaaactgcaccagatcgtgccaagctacggcaccaagctgaacgacagccctgaagctgttgccaaggaatgggcctacacggccggtgtgctgcaactgacaccaccgccagcgatcccgcaactggccgctccacaggctaccgaggctgccaagcctgcggctgagccaagcaagccggcgtctgacctggcgctgtaagcaacacccacgaaaaagcccgctgaaccggtgacggtcagcgggcttttttgtgggcgcagttcagaccttgaagtggcggatttgctcatgcacatgcagcgccagcgcattgccggtatcgcacatcaggtacagatgctgcgcgggtagaggtggcagttctgacatgtggatcagcccttcgcccatacggctttgctccatcaggccaaccgccacgccactgcgtacacaggcttcgaccgcagacgagttggggctttccagcagtagccggtggtagaccccatgatccttcaacgactgcagcgctgcggcgcgataggggcagccagtgatgggcacagtgatgggtaatggcacgttcggcggcgagttgaagccttcggtcgccacccacagcggctgcacggcccccaggcgttcaccttgtgcgagcgggtgcgcgctgacggtgatcgccaagtccagttggttggccatgaataagtccagtaactcaccgctggtgcgcgcttcgatctccagttccagcagggggttgtcagcgatcagtcgcggtaaaaattcctggatgaaggcgggcgcgtaggtatccggcacccccaggcgtatcttgccctgcatgcgctggggcatcagcgaaatcagcaggcggtcatggctcttgagaaattcggtggtttcgccgagcagtttctggccgtacagcgtcaattccacgccctggttactgcggctgaacagacgctgtccgacctggtcctccagcttctggatttgcgtggtgacggtggacgcactgcggtgcacatgctcggccgcgtcgttaaagcgccgaaagcgcgctacggcgtgaaaggtgcgcaacagctcgatgttcagttgtttaggcataattcggatttttcggatttgttgttcgtgtaattcaaatatacgcaagcatgtgcagcctttagcctttgagtcaaatcacagcgatgggaggcgatatgaagcgatctaccttagggttgctgctgttgcaggcggttttcgttttgtcgtggagttcaggctttatcggcgccaagctcggcacccagggtggtggggcgttcaatctgctgttctggcgtttcctgctggtctcgctgtgcctggcgctgttcctgaacaagcggttgctggaggtgacctggcagcagattcgccatcacgcggttgtcggtttcctgtcgcagttcctttatttgagctgcgtttatgtcgccatccagaatggcctgccccccgggatcgcggcgatcattgcggcgctgcagccgttgatgacagcggcattgtcgacgggcatggcgtccgagcgcagtggcggctggcagtggttggggttgatgatcagctttgtcggtgtgtcgattgtgattgccgggcagtatggtggtggcgggcagggtgtcgggttggtcatgtatctcttgcctctggtgtcggcacttgggctgacactggcgaccttgtacgagcgtcgttcggtgcagacccaggacagcgggttggtattgccgctgtttatccagtcgctgttgaccttgataggttttaccgcggccgtgatctacaccgacaccctgagtattccccatgacaccaacgtactgatctcgattgtgtggctgacggtgttctccaccttcctcgcctatttgagcctgtggatgctgctacgggtgatgacggccacccatgtggcggcgctggtgtacctggagccgccggtgacgttggtgtgggctgcgttgatgtttggcgatgtgatccacgcatcgacctacgcgggcattgccgtggtcgtggcggggttggtgctggtgcgcctgaagcgaccgactgtcgcctgtacttcctgaggctggcaggttcagcaaccggacagacaccgcctgttaaaaagtacccagggccaagcaggagcgtggctgaaacaagggggatttttaccagtgcaggtgttgggcgttcgcgcccgagggttttgtatgttgctacgttatgcagcattggccgccatggtggtcgccgcttccgggtgtgtgcaagagcgtgttgtgcatgagcgcaggccggtacaacacgagtacgttgatgtggtggcgccgcaaccgccgccggtgcaggtgatcgaagtcgagccggcggtgcgcgaaggttatatctggtcacgcggttactggcgttgggagggcgggcgttatgtagcagtgcacggccattgggaaccggtgcgtcagggttatcgttacgtacacccgcactgggtgcagcgcaatgatggctaccattggcagatcggtggctgggtccgctgacccaacgccatcttccattgtaggagcgagcttgctcgcgaaaaaaacacaggcaccgcgtgctccctgagtgctcgcgtaatcgttggcgtttttcgcgagcaagctcgctcctacaaaaaagccggcctagccgatccgtttcatacccgctgccttggccgcgtttagatcaaaggtggcggtgtactcgcaaccggctgcatggccacagcgttcgatcaggcagtcggcaaattccgctttgctagcggtgaacttgcgcagggcctgccagatgatatcggcgtgttcgacggtcagttcccgtgtgtacagcaaggtttccagcaccgtcaccacgtcgcttttggtcgattggtagcagaactgcaacacccacaccagctccgtaagcgtcaccaggctgacaaaaccgggtgaggcggcggtgagcgattcgatcagttgggacgccttggccgattgcgcaggatcatcctgggtcacataacgcaccagcacgttggtatccaggccaatcatccagcggttgctccctgggccgcgatggctcggttcatgtcctcgatagacacggtttgagcgggtttgcggatcaaccccttgaggtccttgacggttttgctggcggcgatcatggaaaacttgccgtcttccatctcgacgaattccacccggtcgcctgtttccaggcccaaggctgtcctgacctggacagggatggtgatttgcccttttgaagtgagtgtggcggtagccatagtgaagatctccatcgtgatattccttaccttagggtaaggaatgacagaggacaatatccgttggtccataggtcgctcgcaggtgtgagtcagtcggtagtaaaaccctagtccgaatgctcgatcctcacaccgttggctacgccccaaacagatacaaactatgaccgaccgccgctacctcactgcaccacgcgatagcacggcacatacgccgcgccgcccggcagtttcatgcggtgctgggccacgaatgccttcaatagctcatccagcggtttcatgatcgccgggtcgccgtggatctcatacgggccgttctcttcgatcaggcgaatgcccttgtccttgacgttacccgccacgatccccgaaaacgcccggcgcaggttggccgccagttcgtgggggggcaagctgtggttcagctgcaggctggccatgttttcgtgggtggggtcgaacgggcgctggaagccttcgtcgatcttcagcagccagttgaagtgaaacgcgtcgttacgctcgcggcggaattgcttcacggccttgaggccgacggtcatctggcgcgccacttcggccgggtcgtcgatgatgatctgatagtgctgctgcgccgcttcgcccagggtggcgccgacgaacgcatgcaattgttccaggtagggggcggcgtgtttcggcccggtgaggaccaccggaaacggcaggtcgcgattgtccgggtgcatcaggatgcccagcaggtacaggaactcttcggcggtgccggcgccgcccggaaagatgatgatgccgtggccgacgcgtacgaaggcttccaggcgtttctcgatgtccggcaggatcaccagctcattgacgatggggttcggcgcttcggcggcgatgatgcccggctcggtcaagcccaggtaacggccattggtgatgcgttgtttggcgtgggaaatggtcgcgcccttcatcgggcctttcatcacgccggggccgcagccggtgcacacgtcaaggctgcgcagccccagttcgtgcccgactttcttggtgtatttgtattcttcggtgttgatcgagtgcccgccccagcacaccacgatcttaggctccacacccgggcgcagcgtacgggcgttgcgcagcaggtggaacacatagtcggtgatgccctgggagttgctcaggtcgatgcgctggctatccagctcattctcggtgtagacgatgtcgcgcagggcgctgaacaacatctcgcgggtgctggcgatcatttcgccatcgacgaaggcatcggccggggcgttgagcagctccaggcgcacgccgcggtcctgctggtgaatacgcacttcgaagtctttgtaggcgtcgaggatggtcttggcgttatcgatgtgggcgccggtgttgagaatggccagggcgcactggcggaacagggtgtagatgctgccgctgccggcttcactcagttgctggacttcacgttgtgacagggtttcgaggctgcccttggggctgacggaggcgttgatgacttgacgttggggcattctgattccttgaaagcacagccaccgcacccaatgagttgcgatggcctgagaatggtgggcgccgtttacggtcgcacgagacggttatttacctcaggccaggggccaagcgcaaacaccgtccaacaccatcatgccgcagaacttactcaatcagcttccagtttttgtagaaaacccgacgcagggtaaagaccaggccggcaaagcccgcgatcacggcgttgagcaccgtgggcagcggggtcggccgcacaatgtcgatgaacaggcagtagcgtttggcgtcgttcttgttgaaggaagcgtgcatcaaggtgtcgtcgaagataaacagcgggtcgtcgtgccagtagtgcttgtgcttgcccacctggatatacacgccctcgtgatgcggcgccggcgccatgttgtagagcacgcggaacatcatgcgcagggggccgaagtgaaaggaggtggaccggttttcgttgaacaccgagacaccgatggtcttcacgaagggcaatttcttgcgcagttgcggaatatccagggtggtctcgatcgggcggccgtaccactggaaaaacaacatgccgcgtttcttctcggccatgcgctcgtccaggtagccgatgatttcatccttgtgagccatggcgtcgtcgatcacgtgttgcaggtcttcgcgccaggcgggtggcaggtcatgcatcgtgtagacatggcggttgcggctgctcagcaggtcgagcagggtgttgaagggggcgagcacccaggtattgcggccgttgccgatgaagtatttcttgagggtggcgcggtcatagaggccgttgcgcaggaaatcataaataccgcacagcaccaccagcagcaggaataccaggcaggtacgcgggaaacagtcgatcaacagcagaacgccgagtacccaggccagggacaccagctttttgccgacagcacttttgctcatggaacacggctccaacattgaaacataatgaaacaatatcgtcatcataagggtttatagagccgcgaggggttattaaatagggcgaaattgtgaagcccttgcacaatttgtaaccgttgccgcgcaccctcctaaggtttgtggattgaattttgagaacagaagatttgcgactatcgtgacgcttcggttttttggacgtcatagaccggtacgattgaagttgaatggccaccattggccttcggcaccttggaagaggcagaaatttttatgatcatcaaaccgcgggttcgtggctttatctgtgtgaccgcccaccctgttggctgtgaagcgaacgtcaaagagcagatcgactacgtaaccaagaatggcgtaatcgaaggcggcccgaagaaagtgctggtgctcggcgcttccaccggttacggcctggccgcgcgcatcagtgccgcgtttggctgcggcgccgataccctgggcgtgttttttgagaaagaaggcgaagaaggcaagctgagctccgccggctggtacaacagcgcggcgttcgagaagtttgccgtggaaaaaggcctgtacgccaagagcatcaacggcgacgcgttctccgacgagatcaagcgcctgaccatcgacaccatcaagaaagacctgggcaagatcgacctggtggtctacagcctggccgcgccacgccgtaccgacccgcaaggcgtggtgcacaactccaccctcaagccaatcggcaaggccgtgaccctgcgcggtatcaacaccgacaagggcgtggtggtagacaccactcttgagcctgcaacccaggaagaaatcgacggcaccgtgaaggtcatgggcggcgaagactggcagctgtggatcgacgccctgcgtgacgctgatgtgttggccgaaggcgccaagaccaccgcgttcacctacctcggcgagaagctgacccaggatatctactggaacggttccatcggcgaagccaagaaagacctggataaaaaagtcctgaccctgcgcgaaaacctcgcggcgctcaagggcgatgcccgtgtgtcggtgctcaaggccgtggtcacccaggccagctcggcgatcccgatcatgccgctgtacctgtcgttgctgttcaaggtgatgaaagagcagggcacccacgaaggctgcatcgagcaggtctacggcctgttcaaggacagcctgtacggtaaagagcctaagctcgacgccgatggccgcctgcgcgccgacctcgctgagctggaaccgaaggtgcaggacgccgtggctgcgctgtggaaccaggttaccgacgacaacgtcaacgagatcagcgattttgccggttacaaggctgagttcctgcgcttgttcggctttgaagtcgatggcgtggattacgacgcggacgtgaacccgaccgtcaagatcaacggcctggtccaagcctaaggcctaatgcagacctaaagtgtgggagggggcttgctcccgatggcggtgtatcagtcactatcttcagtggctgacaccctgctatcgggagcaagccccctcccacatttgatccgagtcttttcagacacttcttacgccccggcgcgcgcctctctcttccagatctgccagactccagctgctatcaagccacactaacggaggatctgatgacgattcgtgcagtagtttttgatttcggcggtgtcctgttcgactggagcccgcagcacctgtaccgcaagctgattgccgacgatgcagaacggcagtggttcctcgacaacatctgcacccaggcctggaacaccgagcaagatgccggtcgtaccctggctgaagccacccgcaccctgattgaccaacaccccgatcaccgcaccttgatccaggcttattacgagcgctggcacgagatgctgcgcggtgagttgcccgaaggcgtggcgattctcgaggcgctgcaccaggccaatgtgccgttgttcgggctcaccaactggtcggctgaaacgttcccttatgcccgggccaattacccgttcctgcagcgttttcgcaatatcgtcgtgtccggcgaattgaagttgatcaagcctgatccggcgatctaccacgccagtcttgagcaggttcgtgcccatttgccggatatccagccgagtgaagtggtgtttatcgatgatgtcgaaggcaatatcgacgcggctgtcgccttgggctggcagggtattcaccatgtgtcggccgatcgtaccgctgcgcgtttgcgcgagttgggcgtggccttctagggcgcccatttctccatggcgaagtcgacgaacgcccgcagcttgggcaggcgatagcggtcctggcgatacagcaggtgcatggggcggctgggtagtttataggtggttagcaaggctaccagcttgccgttctccaggtccggttgcaccagggcatcggccagcatgatgatgcccatgccgttgatggccgcctggcgcaagccttgcgagctgttgatggtcaatgagccgccaaccgggacttccacttggccttcgtccccggtcatgcgccagagtttatcggtatcgcgccagttatcgttcgcggggtaggcgaacgccaggcaatcgtgctgctgcaggtcatctggtgtctgcggcgtaccccggcgcgccaggtacgcaggtgacgcgcacagcgtgagggtgtagggctgcatgggcctggcgatcacgctggatgttgccagttcacccaggcggattgccacgtcgaagccgctgtctacgaggtccatccgctcattgctcagcaccacgtacaggtcgataagcgggtagcgctgggaaaactcgcttagggccggcaccaggcgttcagtgccgaacacgggcggcgcagtgatacgcaggctgcctttgggggtgtcgctgtggatctgctcggccagtagctcggagtcggccaccagccccaatacttccaggcaacgctgatagtactgcgcgccaaattccgtaaggttctgtttacgcgtagtgcgtttgagcaagctgacgcccagccgttgctccagggcacgcaaatggttgcccaccatggtggtcgacatcccgcattcgtgggcggcggcggtcatgctgccggtctcgacgactttcacgtacaccgacattgcctggaacaggtccattatcaacccctggtttaaagtcattgcaggaattcagagtttatccagcaagagtggttaacgatactgaaacaatcccaacgatgcactggagccaccccaatgaccgccgcctgcctgatgagcacctatcaacccttggccctgagcttcagtcgtggcctgggcacgcgcctgtgggaccagcagggccgcgaatacctggatgcggtcgccggcgtagcggtgaccaatgtcggtcattcccaccccatgctggtagcggccatcagtgaacaggccggcctgctgctgcacacgtccaacctctacagcatcgactggcaacagcggcttgccctgcgcctggcccaactgtccgggctggaccgtgcgtttttcaacaactccggcgccgaggccaatgagacggcgctgaaactggcgcgcttgcatggctggaaaaaaggcattgaacagccgttggtggtggtgatggagaacgcctttcacggccgcacgcttggcaccatggccgccagcgacgggccgtcggtgcgcctggggttccagcgcctgcccggggacttcatcaaggttggcttcggcgatatggccgccttggagacgatcaccaggcaatacggcacacgcatcgccgcggtgctgctggaaccgatccagggcgaaagtggtgtgctggtggccccacccggttacctcaaagccctgcgcgaccactgcacgcgccacggctggctgatgatgctcgatgagatccagaccggcatcgggcgcaccggcacctggtttgccttccagcacgaaggcatcgtgccggatgtgatgaccctggccaaaggcctcggcaatggtgtgcccatcggagcctgcctggctcgggccgccgtggccgagctgttcacgcctggtagtcatggcagcacctttggcggtaacccgttggcctgtcgcgtgggctgtaccgtgctggagattattgaacagcaaggtttgctacagaacgcggcacaccagggtgaatacctgctggcgcggttgcacatggaattggacgagcacccgcaagtacgggcgattcgcggcaagggcttgatgatcgggatcgaactggccggcccttaccgcgacctggcgcaacgtgccgcccaggagcatgggctgttgatcaacgtcacgcggggcaagatcattcgcctgttgccgccgctgactttgcagcgccaggaagtagaaatgattgtgcgtgccatcacccgcttattgggttgaaatacgatcaaagtgtgggagggggcttgctcccgatagcagtggttcagccactgaagatatcgactgatacaccgctatcgggagcaagccccctcccacagtggttctgtgtagggttcagagggtggggccattcaaccattcctgattcatggtttctgtatcccccaagtactccagcaaccacgccatggccggcgaaagcttgctctgcgcccaggcgacacatgatgggctggccgggaacggtcggcttaattgcagcgccaccaactcgcccttttcgatccacggcaacacctgatgggccggggccatgcccacacacaggccatcgcgcaggcaatcgagcgccgaagcccaattgggcaccaccaggcggcgctggttatccagggtccaggtgtcgcgcttgggcaggttgcgcgaggtgtcggtcatgcacagtgaagcgaaggggcgcagttggtcatcactgagcaaaccttctaccgccgccaacgggtgccgggcactgaccacgcacagccagttcaacaggcccatgtcacggaagctaaagtggctggccaccggcaccgcgctggtggcgccgatcacgatgtcggtgcgctcatcggccagtgcatcccacacgccgttgtacacttcgtattcgagcagcagttccacttcgggaaactgccgatagaagtccagcaccagttggcggcaacgctggggtttgacgatggagtccacggccaccttcaactggccactccagccattggccacctgttggcacaagcgccgggtgccaagcatttttttcatcacgccgcgggcttcgtcgataaacaggcggccggcgggcgtcagctctacgtcgcgatgcctgcgcacaaacaaaggcacggccagccattcctcaagctgacgtaccgtgtagctgatggccgacggcacgcggtgcagttcctgggcggcggcgctgaagctgccgtgtcgggcaactgcatcgaccacatccagggaatattcagaccacatgagggttgccttcaaatttattgataagagcgtccaattattatcgcttcacacacatattgtcagcttcataatgggcgccagtcagcaaatagtttgatggcagtatctacaaggcttcgatgaaaaattcttttggttttacctggtacctggcggggctgagcatgctcggttatctcgccatggacatgtacttgccggcgtttggcgccatgggcgagcagttgcagattggcgccggcgcggtgggcgccagcttgagtattttccttgccggctttgcggtggggcagttggtgtgggggccgttgtcggaccgccttgggcgcaagccgatcctgctcacgggcctgagcctgtttgtgctcgggtgcctgggtatgttctgggtcgagaccgcgccgcaactgctggccctgcgctttatccaggcgattggcgtatgtgctgccgccgtaagctggcaggccttggtgatcgatcgctacccggccgacaaggcccaccgcgtattcgccagcatcatgccgttgatgtcgctgtcaccggccctggcgcccctgttaggcgccttggtgttgaatcactttggctggcaggcgatcttcggcgtgttgctggtggtgtcgctgttgctgctgttgccgacgttgttcctgcgaagcctgcccaagcgtcttgagcatgagggtgcccccacgcgtctcggttatgggcagttgctcacctctaaagtgttcaccggcaatgtgatgatcttcgctgcctgctcagccagcttcttcgcctggcttacggcctcgccgttcatcctgggcggcatgggctacagcccgaatgacatcggcctcagctacgtgttgccgaccctggcgtttctcgttggtggctatagttgccgtagcgccctgcaacacctgtcgggcaaagccctgttgccgtggctgctggctgcgtattgcttgagcatggtggcgttgtacctggtcgccaccctgagcgtgccgaccttgaccaccttgctgatcccgttctgcctgatggcgctgtgcaacggcgccagctacccgattgtggtagcgaatgcgctgatgccgtttgcagaaaactccggcaaggcggcggcactgcaaaacaccctgcaactggggctgtgcttcctggccagtttgttggtgtcgtcgatgatcgagcaaccgctgatgattacggtgattgtgatgttggcgacggcgccgttggcggtgttggggtattggctggcgcggccgaaggcggattgctccgagctggcaactgatctgaagtgacaatgcggccaaaaatgtgggagggggcttgctcccgatagcggtatgtcagtggcagatgtgctggctgatacaccgctatcgggagcaagccccctcccacatcggtcctgaatttattcagttagaacgtcacttccatgttcagggtgggtgttgaggtgcgggttccccgccccccgtccacaccgaatttgttatgccagtattcatagcccacccccaggtacaggttcggcttgacgcttttccccggccgtaccgccaccatcagagccgtacgcatcagcgcttctggcgtggtatcgcggccatggtagtcctcgcctttctccccgacataattgataaacccctggaacttcgccgcatggttgccgacctcgaaagggcgcatccagatcaggttgagcatgtagctgtcgtcgaacgtatggtttgactcttgcgcgccggggatgccggtgtggttcctttccttgtagtacatcaggctcaggtccagtacgccgacggtgttgaacttcaaggtcgggccgatcaccagggcgcgctttttggctgaggcgaagttgttgttgcggttggcgtcaaaacccagagtcagcgcgtaatccttgaccaggccagtgcccagcggcagatcgaacacccgcgaggcatacagctggtgccggtacacggcgtacacctcgctgccgccgtggtcggtgcccttgcgtgggtcgcggctgtcggacaagaacacatccaggttgaggaagttactgccatagcggtagccgctggcgtgggtaaagctgtagatgcgcttgctgaaatcgtcggggttattcgggttggtgaagtgctggccgtagcgaaaacctacgctgttgttcatccattccaccgcgacagcctcgccaccgctgaggagggtcaatgcaacggtggcgccctgtagtgcctttttcattattgttggtcctttggcgttctggctcatgacggccggattatttttgtaacgccgcgggagggtatcttgttcgattgattgtatacaactctatggacatacagtcttaatattgcatacagtgagcgcacaacaaaaacagagaacctctcaccatgactatcccgaaggcgtcaccgcagcggcccgaagacgagaatctgggcgtcgccgccaacatggcttacggcctgcagcatgtgctcaccatgtacggcggcatcgtcgccgtaccgttgatcgtcggccaggcagccgggctgtcgcctgcggatatcggcctgttgatcgcggcatcgctgtttgccggtggcctggccaccttgttgcaaacccttggcctgccgttcttcggctgtcagttgccgctggtgcagggcgtgtcgttcgcgggcgtggccaccatggtggcgattgtcggcagtgacggtgcgggagggatcccggcgattctcggcgcagtcatggccgcttcgctgatcggcctgttgatcaccccggtgttctcgcgaattaccaagttttttccgccgctggtgaccggcattgtgatcaccaccatcggcctgaccctgatgcccgtggcggcgcgttgggccatgggtggcaatagccgtgcggcggatttcggcagcatgtcgaatatcggcctggccgcattgaccctggtgttggtgctgttgttgagcaaaatcggcagcgcaaccatctcgcgcttgtcgatcctgctggcgatggtgattggcacggtgatcgcggtgctgctcggtatggctgacttctccggcgtgacccaggggccgatgttcggcttccccacacctttccatttcggcatgccgacctttcatgtggcagcgatcatttccatgtgcatcgtggtgatggtgactctggtggaaacctcggcggatatcctggcggtgggtgagatcatcgacaccaaggtggattccaagcgcctgggcaatggcctgcgtgcggatatgttgtcgagtatgtttgcaccgatcttcggttccttcacccaaagcgcgttcgcccagaacgttggcctggtggcggtgactggagtgaagagccgttttgttgtggctaccggcggggtattcctggtggtgctcggcctgttgccgttcatgggccgggtgatcgccgcagtgccgacctcggtgctgggcggtgcaggcattgtgttgtttggcacggtggcggccagtggtattcgcacgctgtccaaagtggattaccgcaacaacatgaacctgattatcgtggccacgtccattggcttcggcatgatcccaattgccgcgccgagcttctatgatcactttccaagctggttcgcgaccatcttccattcgggcatcagttcgtcggcgatcatggcgatcctgctgaacctggcctttaaccacttcaccgccggtaactcggaccagcagtcagtgtttgtggcggggactgagcgcagtttgtgcttccgcgatgtggccgcgttgcgtgacggggattactacaggggcgggaagttgtttgatgcagagggcaaggagattcccctggtagcggatacctcaaagaaaaccgcaaaacccgaaaccacagaggtctaaaaatgtgggagggggcttgctcccgacagcagtgtgtcagccactgaagatattgactgatacacggtcatcgggagcaagccccctcccacattggaatctagccagccttgcgggctttgtgcggcattgaacacacctcatccaagaacttcaccaccgtccccatgcacgcctggcgttcttccacatggggcatgtggctggagtcttcaaacaatgcccagcgcacgtctgcgatttcatccaggaacggcttgaccaccaacggcgtggcctcgtcatgtcggccggaaatcaccagggtcggcaccttgattgccgcgaggcgaccgttcacgttccagtccttcaagctaccgatcacgtggaattcggtcggaccgctcatggcgtggtacaccgtcgggtctgcatcgacctgggcgaaggtgcgcgccacttcttccggccagggtttgacgcggcacacgtgctgatcatagaaaacccgcgaggcggccaggtattccggatcttgataggtgccggcctgttcgtgcttgagcagggtttcatgcacgccctcaggcaacaacttgcgcaggcggttggcttcgctgacccaggtgcgcatgcaggtcggtgagttggcgggaataaacgcgcgcaggcccttgggctgcaggatcgcgtgttcgctgcccagcatgccgccccaggattggccgaggatcgcgtaattattgctgatctgcaggtggtccagcaggttgttcaactcgtcgaggaacaggctgatggtccagaacgatgggtctttatccggcaagtgcgtggagcggccattgcccaactgatcgtagtgaatcaccgcatggccgctggcggcgacgtccttgaaggcatcgacataatcgtgggtgcagcctgggccgccatggatgatcaccaatggcgtacggcctgtggtcaggtcgcccgtgacgcgataccaggtctgatacgcgccaaagggcgcatagccttcgcgaactttttcgatgaattccatttcgtgccccgctctgaaaaaagcatcagggctacgatagtctgaacaaaaagtttaggtaactagcaaaacagctaggtttttccggtgggtcaaccttccagcagacggtaatgggtggcccgcaccaccgcctgtacgcggttcttggctcccagtttgtgcatggccgaggccaggtgcagggtgaccaccgccagggaacgactcaattgcgtggcaatttcggcagcggtcaggccgtcggcggcccatttgaggcattcgcgttcgcgcttggtcaggtggatatgcgggtaggcccttagctccttgctgaacagcgggtaggccgcttcctgcagggcatgggtaatcaggctgaaatcggccaacgtatgttgtgcgtccttcaataccgtgcgcgccttgccggtgcgcaacccggtcagcgacgcgaagccgccccggggcaggtgaatagggacgctgacgccacaggtcagctcacgctcgtgcaagtaagaggatacgggcgcgtggcacgggtcgatgatcttctgcagggccgtctctgtcttcgcctcataggaccagacaaacggcgataccgtactcaacgccaggtgctgcaccgggtcgatctggtagaacccttcgctgcaccataaggcatgccaatccggcggggtgttgcgcagctccagcacagaaggggtgatcagcgtgccattgaggtcgataggtaccggcgtgtagtcatacaccaatgcatcgaagcccagttgttgggccaggataaacgtattgtccatctgttcatccaggctcctgcctggcatgaggcgattattgaaggcggtcagcttggccagcatccgttctgctcccgaattcatttgaatctcgacttgcggcaagtagaatgccacgccccggcgaaggactgccaggccaaacctataagaaatactaggttatggacgcacggcatcctcggtagtgtttacctgataaacggccgctacccgccaggccgatacaacacaaggaatgtatgcatgtggcgtgaaattgcccccgaccagcagtacaacgtgcaagtcgacggccacaacctcgtggtctacagcttcggcgaaggcgatgaggtgctgctgtgtctcaacggcgggccgggcctgccgtgtgactatctgcgcgacgcccatggctggctcaaagcgcataacctgcgagtggttgcattcgaccagcttggcacgggcgcatcagccagaccgaccgatgccgccctgtgggaaattcgccgttatgtcgaagaagtcgagaccgtgcgccaagccctggatctgggccgcgtgcatctgctcgggcactcctggggcggctggctgggtatcgaatatgccatccattaccccgatgccctgaaaagcctgatactggaaaacaccgtcggcgacatcccgcatttgtcccaggaactcgaacgcctgcgtggggcgctgggcagcgaaaccgtggccatgatgcaacgccatgaagccatgggcaccctcgaccacccgcaataccaggctgccatcaccttgctcaactatcgtcacgtgtgccgcctcgaccaatggccggagccgctcaagcgttccctggacgactggaacatgggcccctacgaaaccatgcaaggccccaacgagttcctctatatcggcaacctcaaggactggaaccgcctcgaggaaatggccggattcaagatgccgatcctgattaccaccggccagcacgacgaactcacccccgcctgcgccatgcgcatgaagctggcggcccggcatgcccaattgcatgtattccccaatagcagccatatgccattttacgaggagccccaggcgtacttcccggtgctgctggactttctcgcccgccaccgaggttgacgcatgaatctggcgcgttaccgttttgtcctgtcccggccgctgcaactgctgccggtgctgtttggcatcagcctgatcacctttgtgctggtgcgctcgatccccggcgacccggcgcgggcgctgctgggttcacgcagcacgccggatgctctgctgaaaatccgcgcccagttcggcctcgatcagcccttgtggctgcaatatttctacttcctgaaaaacctgctcaagggcgatctcggtcaatcgctgctgtacaaggtcgatgcgctgaaactgatcgtgacccgtatcgagccgacgctggtgctggtgctgggcagcgtggtgctggcattgctgatcgcggtgccgttggcgacagtggcggcacgcaacaaaggcggttgggcggataacctgatccgcgtttttaccacggtcggcctgggcatgccggcgttctggctggggttgatgctgatcctgctgctcagcgtgcaatggggtttgttcccggtgtccggctacggtcgcacctggctggacaaggcgcaccatatggttttgccctgcctgaccatcgccctggcgctggcggcggtgctggtgcgcaacctgcgcgcaagcatgctgatggagttgcaggccgatcctgttaccgccgcccgagcgcggggcctgtcggaagccgcggtgtttcgtcggcatgtactgcccaattccctggtcccggcggttaacctgctggcggtcaacattggctggctgatcagcggcacggtggtcatcgaaagtctgttcgctatcccgggcatcggccagttgctggtgcgcggcatcttcacccgtgactacatggtggtgcagggcgtggcgatggtgctggcgtgtgccacggtgctggtcaatttcattgccgacgtggtgacggtggccctcgacccacgggtgaagatgcaatgagcagccgcccactgattgccccatggcgcttgcgcctgcgctttggctttcgcaacgggcgaatgaccgccgcgtggggcctgttgatactgttcgcgtggttgggcctggcgttgtttgcgccgtggatcgcaccttttgatcctatcgcgcagaataccgacatgagtttgctggcccccagccttgcacatccgtttggcacggataactacggcagggatatcctttcgagggtgatctggggcgcacgcatcgatctgcaactggcggttgtcggggtgatcttcccgttcatcatcggcaccttaatcggtgcggtgtccggttatgtcggcgggcgtttcgacagcttctgcatgcgtgtgatcgatgtggtgctggcgtttccgttcctggtgctgatgctggcgatcatggccatcctcgggccgggcttgaagagtttctatatcgccatggcgttggtgggctgggtgtcgtatgcgcggctgattcgctcgcagatcctggtgctcaaggaaagcgagtttgccctggccgccaagagcctgggctttggtcatgggcgcattctgttccggcatttgctgcccaacgcgctgtttggctccatcgtattttccatgtccgacgcggtgctggtgctgctcaacggtgccgccgtgagttacctgggcctgggcgtgcaaccgcctaccgccgagtgggggacgatggtggccgaagggcaagcctttatcaccaccgcctggtggatctgtacgttcccgggcctggctatcgtgaccctggccatgggtttcagcctgttggctgatggcgtcgcccaagtgttgggggatcgctcatgagcctgctgcaagtacgcgacctcagcgtgatcgcccataacgccgggcgcgatgtcaccctggtggatcgtgtgtccttcgacctggccgaaggtgaaatcctcggcttggtgggcgagagcgggtccggcaagaccatggcctgtcgtggcctgatacgcctgctgccctctgcgaatctacgcgtgcaaggtagcgctgtacacctggccggccaggatctgttgcagctcgacgatgccggcatgcgcgccgtgcgaggcgggcaactgggcatgatcttccagaaccccggcagccacctggacccgctgatgcgtattggcgagcagatcgccgagggcatccgtctgcatcaaggggcatcgaaaaaagacgcacgcttgcaggccattgaggtgctgcgccaggtcgggatccctgacccacaggcgcgggtcgacaactacccccatgagttttccggtggcatgcgccagcgcgcgatgattgccgtggccctgggctgcaacccgaaagtgctgatcgccgatgagccgaccacggccctggatgtgacggtgcaggcgcaaatcctgcgcctgttgctcgacctgcgtgaccagcgtggcctatcgatcatcatgatcacccatgaccttggtgtagtggcgcagacttgcgactccatcgcggtgatgtacgccgggcgcctgtgcgagcatggcagcaaatacgagctgctggcgcacccgcaacatccgtataccgctggcctgatcgattgccagccggcccatagcagcggccatgccttgttgcgcactatccccggccagccgccgttgctggatgcattgcccgatggttgccgcttccacccgcgctgcccccaggccggtaccttatgtgccgaggtgttgccccagggcgcacgcgtggcctgtcactatccgttgggagggcgaccatgagcctgttgcagatcaaggacctggaggtgcgctttgccgcgtctggcactggcctgttcggcctcaacaagcagtgggtgagggcggtgaacggggtgtcgctgaatttggccgccggtgaaaccctgggtttggtgggcgaatccggcagcggcaagagcaccctgggccgggcgattctgcacctcaacccgatcagcgccgggcaggtgctgtttgacggtgtcgacatggcccatggctgcgccattgacatcgcccgcctgcgccatgaaaccgcgatgattttccaggacccctacgctgcgctgaacccacgccagagcatcggcgagatcattgccgaggtgttgcgcgtgcagcgcaaggtggctgtggcgcagatcccggcgcgggtcaatgagctactggcgctggttggcctgcgccccgagttggccacgcgcaaaccaggctcacttagtggcggccagtgccagcgcgtcggtattgcccgggcgctggcggtggagccacgcctgatcattgccgacgaatgtgtggcggcgctggatgtatcgatccagggccagatcatcaacctgctgctggagctgcaacagcgcatgaacctggcgatcctgtttatcgcccatgacttggccatcgtgcggcgcctgtgcgaccgcgtggcggtgatgtacctgggcaagatcgtcgaggaagggccggtggaagcggtgttcaccgcgccgcgtcatccgtacacggcggcgttgatcgaggcgattcccgagatcgatccgcatcggccgttgcccgcgcagccgttgcccggcgagccgccgagcccgctggatttgccttcaggctgcgcctttcacccacgttgccggcatgcccgagcgatgtgttcggtggtgttgccgccgacccatttcctgcacgagcatcggtacagttgcgtgcttgaagaacctttgctttgaccctctgccattcattaacaaggagttgtgatatgcaatcgcgccacttgaaattgctcgccgccgcaacgctcaccgcttggtcgctgaccgctggcctggcccaggccgccggcgtcctcaccatcggctgccgtgaagacagcaccacctttgacccgatcaaaagcgcgcaaaaccgcgacacctgggtgtttgccaacgtctacgacaccctggtacgcgtggataacctgggcaccaagatggaaccgggcctggccgaaagctgggagatttccaaggacggcctgacctacaccttcaaactgcgcgaggcgaagttctccgacggatcaaagatcaccgccgatgacgccgcgttcagcctgctgcgcatccgcgacaacaaggcgtcgttgtggagcgacccgttcagcctgatcaataccgccaaggccagcgatccgaagaccctggtggtgaccctgaaaaccccggcggtggctttcctctcgcaattggcgtcgccgacggtatcgatcctgtcggaaaaagccatgaccaccctgggcgaagacgcctactcggaaaacccggtgacttccggtgcgtttaccgtggaagaatggcgcaagggcgaccgagtcatcctcaaaaagaacccgaacttctggcaggccagcaacgtcagcctcgacggtgtggagtgggtgtcggtaaccgatgacaacacgcgcatgcgcatggtgcagaacaacgaactcgacacggcgatcttcgtgccgttttcgcgggttgaagagctgaaaaaagacaaaaatgtggtgatccactccgacccgtccacccgtgaagatcacctgttgatcaaccacgagcacggcctgctggccaagccgcaagtgcgcgaggccctggacatggccatcgacaagcaatcgctggtgaagaccgccacatacggtcaaggcactgtggcctattcctacattccaaagggctcgctgtatcactacgccaacaacctgcaacgcccgtatgaccctgctgcggccaaaaagctgctggaagaggccggcgcccaggactttaagctcaactacgtggtcaacgccggcaacgaggctgacgagcagattgcggtgatcatcaaggaccagttggccaaggtcggcgtgaccgccaacctgcaaaaggtcgacccgacccaaagttggcagatgctggtggacggtgagtacgacatttcggtgatgtactggaccaacgacatcctcgacccggaccagaagaccaccttcgttctgggccacgacaccaaccagaactacatgacccgctacaagaacgacaaggtcaaagcgttggtcgcggctgcacgggtggaggctgacccggccaagcgtgagcagatgtatgtggagttgcagaagctggcgaaacaggatgtgaactggattgacctgtactacagcccgtatatcaacatctcacgcaagaatgtgagcaacttcctgcagaacccgttgggccgcttcacccttgaggaagtagtcaaaaactaaagaatgctgggtatcaatgtgggagggggcaagccccctcccacattttgatctggtttgtgtcagctattattgagcatcaaacgcctgcccattgatgccggcactgtccggccccatcaggtacaggtacaccggcatgatttcttccggcgccggccgctccatcgggttctcccccggatacgcctgggcccgcatgctggtgcgggtgccgccggggttgatgctgttcgagcgtactgccgccacatcctcaagctcatcggccagtgtctgcatcagcccttcggtggcgaatttcgacaccccatacgcaccccaataggcacggcccttacgcccgacgctgctggaagtgaacaccaccgatgcatcctgggacagcttgagcaacggcagcaaggtggcggtcagcatgaacatcgcgttgacgttcacatgcatcacccgcatgaaattctcgccggataactgctcgatgggcgtgcgcgggccaatgatcgacgcgttgtgcagcaggccgtcgaggtggccgaactccttctcgatcattgccgccaactcatcgtactgatggggcagggcggtctccaggttgaacgggatcaccaccggttgagggtgaccggcggcttcgatctcgtcatagacttgggccaggttggcttcggtcttgcccagcaacagcacggtagcgccatgggcggcataggtcttggccgctgctgcgccaattccccgaccggcaccggtgaccaggatgactcggccgttgagcagttctggaggtgcggagtaatcaaacataaatagcctcgacagagtttagcgggtgatcaacacttggctggaaaacactgaaaatcccctgtgggagggggcttgctcccgattgcggtggttcagcaataaatgtgttgaatgacacactgcaatcgggagcaagccccctcccacattggatctacatggatcagtaagatcggtaagccatcagcaactgcacagcgcgttatccagcactttacgcagctccaatgggtggtccaccaccacatccgcaccccagtgacgtgggttgtcatccgggtggatatagccgtaggtcaccgccgccgtgcgggtgccggcgccgcgaccggactcgatatcgcgcaggtcatcaccgacgaacaacacactggccgggtccaggccgagcatttcgcacgccaggatcatcggctcggggtccggcttgctgttcttcacatggtccgggcagatcagcacggccgagcgctcggccaggcccagtcgctgcatgatcggttcggcaaagcgcacgggcttgttggtgactacgccccagatcagcttggctttctcgatgtcttccagcagctcagccatgccgtcgaacagtttgctgtgaactgcacagtccttgaggtagcgctcgaggaactccaggcgcagtgcttcaaagccgggtgattcagggtccattgaaaaggtcacggcaaccatcgcccgcgcaccgccggagatctcatcgcggatgtgctgcgggttgatcggctccaggccccggtcggcgcgcatggcctggcagatggcgataaagtccggcgcggtatccagcagggtaccgtccatgtcgaagagaaccgctcgcaacttcacaggcttactcctcgcgcagggtctggatcatgtagttgacgtcaacgtcgctggccagcttgtagtgcttggtcagcgggttgtaggtcaggccgatgatgtccttgacggtcagcccggcctgccggctccacgcgcccagctcggaggggcggatgaatttcttgaagtcatgggtgccgcggggcagcagcttcatgatgtattcggcaccgatgatcgcgaacaggtaagccttggggttgcggttgatggtggagaagaaaacctggccgccgggcttgaccatgcggaaacacgcacggatcaccgaggatgggtcgggtacgtgctccagcatctccaggcaggtgaccacgtcgaagtgctcgggcatttcctcggccagggcttcggcggtgatctggcggtattccacgctcacgccggattccagctggtgcaactgggccacggccaggggcgcttcgcccatgtcgatgcccatcaccgtggcgccgcgctgggccatggcttcgctgaggatgccgccgccgcaaccgacgtccagcaccttcttgccggccaggttgacgcgttcgtcaatccagttgacccgcagcgggttgatgtcgtgcaggggtttgaactcgctctcgcggtcccaccagcggtgggccagggcttcgaatttggcgatttcggcgtggtcgacgttgctcatggtcaatcctctaaatctgataaatcggtgggtcggtgctgagcgcatgggctcagtaccttcgttattcgctgtgcccgctgatgcgttggccccaggcaatggccgtggcggtcaactgctgttcatccatgcgggtcaattgccgatcgtcgagcaatggcttgccggcgacccaaaggtgtttcacgcaatcacgtccggtggcatatataagctgtgagaccggatcgtagatcggttgttgcgccagccccgacaaatcaaaggcgaccatgtctgcggccttgcccacttccagcgagccgatctggctttccaggcccatggcccgcgcaccgttgagggtcgccatacgcagggcgcggtgcgcatccagggcggtggccgaaccggcgacggccttggccaacatcgcggcggtgcgggtttcgcccagcaggtccaggtcattgttgctggcggcgccgtcggtgccgatggccacattgacccctgcctgccacaagcgctccaccgggcaaaagccgctggccagtttcaggttcgattccgggcaatggataacactggtgttgctttctaccagtaaagccaggtcatcctcgctgatttgggtcatatgaacggcctggaagcgcggccccagcaagccgaggcgacccaggcgcgccaatggccgctcgccggtctgctccacggcttgctgcacttcgaaggcggtttcatgcacatgcatatggatcgtggcgtccagctcctcggcaaccacgcggattttctccaaattggcatcgctcacggtgtagggcgcgtgagggccaaaggcgatcttgatgcgcgggtgatgcttgaggtcgccgaacagctcgatagcctggcgaagcgcctcgtcggcgctactggcgccgggaatcgggaaatcgaggatcggcatcgcgatctgtgcacgcatgccgctgttgtgcacgcagtcgctggcgaccttggggtagaagtacatgtcgcaaaagcaggtgatgccgcccttgagctgttcggcgatggccaggttggtgccgtcgcgcacgaaggcttcatcgacccacttggcttcagcgggccagatgtgtttttccagccaggtcatcagcggcaggtcgtcggccaggccacggaacaggctcattgctgcatggccgtgggcgttgacgaggccggggctgagcagcatgccgggcagctcgcgcacttccttggccgcaagcttcaacgccgccgcccgcgggccgataaaggcaatgcatccgtcgcggatgcccaggccatgctccttgagcactacgccggcaggttcgacgggtaccagccaggtcggcagcagcagcaagtcgagcggggcggcagaggtggtcatcgcaggctttttcccaggcagctataaaagaaggtcgaagtatacccgagcgtcctggctggcggatcgctataatccgcggcttttgttcatgagtgcggggtaagggatgcgcgaccgactgttggctgcagagaacgtgaaggccatcgattggcgtgatggcgcgctgtatctgctcgatcaacgtgttttgccgtcccaggaaagctgggtagcctgccgtaccgtagaggcagtggctgatgccatccgctccatgctggtacggggcgcgccggccattggcatctgcgccgcgtatggcctggtgctggctgcccgtgagcgcatcgctcaaggcggtgactggcaggccgcctgggaagaagactacgcactgttagcccatacccgacctactgcgtcgaacctgttctgggccttgcagcgcatgcgcgaccgcctggaccgcctcaagaagcacgccgatccgctggtggtgctggaagccgaagccattgcgatccatgaaagcgaccgggaggccaatttcgttatggcccagctaggcgtggagcggattcgcaagcaccagggcaacgcccaggcgttcctgacgcatggcaataccggcgctttggccacgggcggcgtcggcacggccctcggcgtcattcgcgcagcgttccttgaagggttggtggagcaggtctatgtcaacgagacccgtccctggctgcaaggctcgcggctgactgcctgggagctggcgggcgacggcatcccggtgacggtgaatgccgactcggcgggggcgcatatcctcaagaccaagggcgtgacctgggtgattgtcggcgccgactgcattgccgccaatggcgatgtggtcagcaagatcggcacttatcagctggccgtctgcgccatgcaccacggcgtgcgcttcatggtggtggcgccgagctcgaccctcgacctgatgatggctactggcgatgacgtcgcgctggaggcgcgtgatcccggcgagttgctggaggtgatggggcaacgcttgaaggtagatgccattaatccggtgtttgatgtcaccccggctgacctgattgacgtgatcgtgactgagaagggcgtggtcgagcggccggatacggccaaattggccaggttgatgtgccgtaagcggctgcattgagggctgtggtgtctgtgaaatggctatcgggggcaagcccctcccgcacttcgattgtgagcacagtcaaaaggtgggagggggcttgcccccgattggcccttaaagtcaacaaagcctccagatccagcctcaaaaaaaagcaccaccccacctctgagcccctctcgtcgccctcaagcctgtcatccgtcaaattactagtctccatgcgcatcagggggataggtgcgtggcggcgattgtgataacatccggcggtttccagggccacctcgaggggttgcccataacgtgcagatccgtgtcataactcgttgatttgtcgtaagtcgttgtcaggcactgtgccggcagcggcgagcttcgttcgtcccatatggatgcgacgaagtttcacccgaaaaaggaatcaggcttctcatgggcgaactggccaaagaaatcctcccggtcaatatcgaagacgagctgaaacagtcctacctcgactacgcgatgagcgtaattgtcggtcgggcactgcctgatgcgcgcgatggcttgaagcccgtgcaccggcgtgtgctgttcgcgatgagcgagctgggtaacgactggaacaagccgtacaagaaatctgcccgtgttgtcggtgacgtgatcggtaagtatcaccctcacggcgacactgcggtgtacgacaccatcgttcggatggcccagccgttttccctgcgctacctgctggtagacggccagggcaacttcggttcggtggacggcgacaacgccgcggccatgcgatacaccgaagtgcgcatgaccaagctggcgcacgagctgctggccgacctgcataaagaaaccgtggactgggtgccgaactacgacggcaccgaaatgatcccggctgtcatgcccacccgcatccccaacctgctggtcaacggttccagcggtattgccgtgggcatggccaccaacatcccgccgcacaacctcggtgaagtcatcgacggttgcctggcccttatcgacaacccggagctgaccgtcgatgagctgatgcaatacatcccgggcccggacttcccgaccgccgcgatcatcaacggtcgcgccggcatcatcgaagcctaccgcaccggtcgcgggcgcatttacatgcgcgcccgctcgatgatcgaagacatcgacaaggtcggtggccgccaacagatcgtcatcaccgaactcccgtaccagctgaacaaggcgcgcctgatcgagaagatcgccgagctggttaaagagaagaagctcgaaggcatcaccgagctgcgcgacgagtccgacaaggacggcatgcgcgtagtgatcgagctgcgtcgtggcgaagtgcctgaggtgatcctcaacaacctctacgcccagacccagctgcaaagcgtgtttggtatcaacgtggttgcactgatcgacggccgcccacgcatcctgaacctcaaggacctgctggaagccttcgtacgtcaccgccgcgaagtggtaacgcgccgtaccgtgttcgaactgcgcaaggctcgcgagcgcgggcacatcctggaaggccaggccgttgcgctgtcgaacatcgatccggtcatcgccttgatcaaggcttcgccaaccccgtcggaagccaaggaagcgctgatcagcacgccttgggaatccagcgctgtggtggccatggttgaacgtgccggcgccgactcgtgccgtccagagaccctggacccacagtacggcctgcgcgaaggcaagtacttcctgtcgccggaacaggctcaggccatcctggaactgcgtctgcaccgcctcacgggccttgagcacgagaagctgctggccgagtaccaggagatcctcaaccagatcggcgagctgatccgcatcctcagcagtgccgtgcgcctgatggaagtgatccgcgaagagctcgaagtgatccgcgccgaatacggcgacgtgcgccgcaccgaaatcctcgatgcacgcctcgacctgaccctgggtgacatgatcccggaagaagagcgtgtggtgaccatctcccacggcggctatgccaagacccagccgctggctgcgtaccaggcccagcgccgtggcggtaaaggcaaatcggctaccggcgtcaaggatgaggactacatcgctcacctgctggtcgccaacagccacaccacgctgctgctgttctccagcaagggcaaggtgtactggctgaaaacctacgaaatcccggaagcttcccgcgccgcacgtggtcgcccgctggtcaacctgctgccgttggacagtgatgaatacatcaccaccatgctgccggtcgaggaatacaccgaaggtcacttcatcttcatggccaccgccaagggcaccgtgaagaagaccccgctggaatccttcagccgtcaacgcagcgtgggcctgatcgccctggagctggacgaaggcgacgtactgatttctgctgccattaccgatggcgagcgtgaagtgatgctgttctccgacggcggcaaggtcacccgcttcaaggaatccgacgtgcgtgccatgggccgtaccgcccgcggtgtgcgtggcatgcgcctgccagaagggcaaaagctgatttcgatgctgatcccggaagaaggcagccagatccttaccgcttccgagcgtggttatggcaagcgcaccgctatcagcgagttcccggagtacaagcgtggcggccaaggtgtgatcgccatggtcagcaacgaccgcaacggccgtctggtcggcgcggtgcaggtgctcgatggcgaagagatcatgctgatttccgaccagggcaccctggtgcgtactcgtgtggctgaagtctcgagcctgggccgtaacacccagggcgtgacgctgatcaagctggccaaggatgaaaaactggtcggtcttgagcgtgttcaggagccttcggaagttgaagatgaagagctggaaggcgaggaattcgacggcgaggtaatcgcagccggcgatgacaacgtcgacgagccaaccctcgatgctgccgcagacgaagaagaaccgcaggaataagcggacacacagggggcggatgaagattcgcccccttgttgtttgtccggatggaaatatcgacagcgatgaaaatccagctgtgggagggggcttgctcccgattgcggagtgtcagtggcacataagctgactgacccaccgctttcgcgagcaagcccgctcccacattggatcgggtgtcgcctgatatgtttgcgtgactaccaccagatcagagtgagattggatgtgagcaagagagcctataacttctgtgccggtcccgcggcgcttcctgaagcagtcctgcagcgtgcgcagggtgaactcctcgactggcatggaaaaggcctctccgtgatggaaatgagccatcgcagcgatgagttcgtatccatcgccagcaaggccgagcaggacctgcgcgacttgctggacatcccatccgactacaaagtgctgttcctgcaaggcggtgcgagccagcagttcgctcagttgccgctgaacctgttgccggaagatggcactgccgactatatcgacaccggtatctgggggcagaaagccattgaagaggcttcgcgctacggtcacgtcaatgtggcaggcaccgccaagccctacgactacttcgccattccaggccagaacgagtggaagctgtccaaggatgcggcctacgtccactacgtagcgaacgaaaccattggcggcctggaattcgactgggtgccggaagtgggtgacgtgccgctggtgtgcgacatgtcttcggacatcctttcgcgcccgatcgacgtatccaaatacggcatgatctatgccggcgcacagaagaacatcggcccgagtggcattctggtcaatatcatccgcgaagacctgctcggtcgcgcgcgctcgctgtgcccgaccatgctcaactacaaggtcgcggccgataacggctcgatgtacaacacaccgccggcttttgcctggtacctgtcgggcctggtgttcgagtggctgaaagagcagggcggtgtggctgccatgggcaagcgcaatgaagagaagaaacgtaccctgtacgacttcatcgacgccagcggcctgtacagcaacccgattaacctgactgaccgctcgtggatgaacgtgccgttccgcctggccgatgatcgtctggacaaaccattcctggccggcgccgacgcgcgcggcctgctgaacctcaagggccaccgttcggtcggcggcatgcgtgcctccatctacaacgctgtcgacatccacgcgatcaacgcgttggtggcctacatggcagagttcgaaaaggaacacggctaatgtctgagcaagaactcaaagccctgcgcgtacgcattgacagcctggacgagaaagtcctggagctgatcagtgagcgtgcgcgctgcgcccaggaagtggcacgggtgaaaatggcgtccctggcggaaggcgaagtgccggtgttctaccgacctgagcgcgaagcccaggtgcttaagcgcgtgatggagcgcaacagggggccgttgggtaacgaagagatggcgcggttgttccgcgaaatcatgtcctcgtgcctggcgctggagcagccgctgaaagtggcttacctcggcccggaaggcaccttcacccaggccgcagccatgaagcacttcggccacgcggtgatcagcaagccgatggcggccatcgacgaagtgttccgcgaagtggcggccggggcggtgaattttggcgtggtgccggtggaaaactccaccgaaggcgcggtcaaccacaccctggacagcttccttgagcacgatatggtgatctgcggcgaagtcgagctgcgtatccaccatcacctgctggtgggtgagaacaccaagaccgacagcatcagccgcatctactcccacgcccagtccctggcccagtgccgcaagtggctggatgcacattacccgaatgtcgagcgcgtggcggtgtccagcaacgccgaagcggccaagcgggtcaagggtgagtggaattcggcggcgattgccggcgatatggctgcgggcctgtacggcctgacgcgcctggccgagaagatcgaggaccgcccggacaactccacgcgcttcttgatgatcggtagccaggaagtgccgccgaccggcgacgacaagacctcgatcatcgtctccatgagcaacaagcccggcgcgctgcatgagctgctggtgccattccacgataacgggattgacctgacgcgcatcgaaacgcgtccttcgcgcagcggtaaatggacttatgtgttctttatcgacttcatcggccaccaccgcgacccactggtcaagggtgtgctggagaaaatcagtcaggaagccgtagcactcaaggtgctgggctcgtacccgaaagcggttttgtgaggctttgacatgagtggcaacttcctcgccctggctcagccgggcgtgcaacaactctcgccttatgttccaggcaagcctgtggacgagttggcccgtgagttgaatctggacccgtccaggatcgtcaagctggcgagcaacgaaaacccgctgggcccgagccctaaagtgcttgcggcgattcgggaagagctggccgagctgacccgttaccctgatggcaacggctttgcgctcaaatccctgctggcggacaaatgccgggtcgaggtgaatcaggtgaccttgggcaatggctccaatgacatccttgaattggtcggccgtgcctacctggcaccgggtttgaatgcggtgttcagcgagcacgcgtttgcggtctacccgattgtgacccaggccgtgggggctgatgcccgcgttattccagccaaggactggggccacgacctgccggcgatgctggcggccatcgacgcgcaaacccgcgtggtatttatcgccaacccgaacaacccgaccggcacctggttcgacgagcaggcgctgaacgaattcctgcaggatgtaccggagcatgtgctggtggtgctggacgaggcctacatcgagtacgccgaaggcagcgacctgccggacggcctcgacttcctggcggcctacccgaacctgctggtgtcgcgcacgttctccaaggcttatggcctggcgtcgctgcgggtcggctacggcttgtccacggcggtggttgccgacgtgctgaaccgtgtgcgccagccgttcaacgtcaacagcctggccctggcggctgcgtgtgcggcggtaaaggatgccgagtacctggaagaaggacgtcgcatcaacgaaagcggcatgctgcagttacaggaaggcttccgcgagttgggcctgggttggattccgtccaagggcaacttcatctgcgtcgatctcggccaggtggctgccccggtgttccagggcctgttgcgcgaaggcgtgatcgtgcgtccggtgggcaactacggcatgccgaaccacctgcgtatcaccatcggtttgccggctgagaacagccgcttccttgaggcgctggccaaggttctggcccgtggttgatgtcactgcattgcaacctgctgtgcctatgattggtcgccttgtggtggtcggcctggggttgatcggtggctccttcgccaagggtctgcgcgaaagcggattatgcggcgaagtggtgggcgtggacctggacccgcagtcgcgcaagctggcggtggaattgggcgtagtggaccgctgtgaggcggacctggcaattgcctgccagggcgcggatgtgatccagctcgccgtaccgatcctggccatggagaagctgcttgcggtgttggctggcatggatctggggcaggcaatcctcacggacgtcggtagcgccaaaggtaatgtggtgcgtgctgcgcagctggcgtttggcgaaatgccgccgcgctttgtgccgggccatccgattgccggctccgagcagagcggggtggaagcctccaatgcacagttgttccgtcggcataaggtgatcctcacgccgcttgcgcaaaccgatccggcggcgctggccgtcgtggatcgtctctggcgcgagctgggggcggatgtggagcacatgcaggtcgagcgccacgatgaagtgctggcggcgaccagccatttgccccatttgctggcatttggcttggtggattccctggccaagcgcaatgaaaacctggagatttttcggtatgccgccggtggcttccgcgattttacgcggattgccggcagcgatccggtgatgtggcacgacatcttcctcgccaatcgcgaagcggtgttgcgtaccctggacaccttccgcagcgacctcgacgccctgcgtgacgcggttgacgcgggtgacggccatcaactgttgggcgtgttcacccgtgcgcgggtggcgcgtgaacatttcagcaagatcctggcacgccgggcttatatggaaaccgcagtgagcgccgatgagctgactttcatcgccagcccgggaggccgcttgagcgggcgtattcgggtgccgggtgataagtcgatctctcatcggtcgatcatgctcggttcgttggccgagggcgtgacagaagtcgaaggtttccttgagggcgaagatgccctggcgactttgcaggcatttcgcgacatgggcgtggtgattgaagggccgcaccatgggcgcgtgactatccatggcgttggcctgcatgggttgaaggctgcgccggggccgatctacctgggtaattccggtacgtccatgcgtctgctggccggtttactggcggcccagagcttcgatagcgtgttgaccggcgatgcatcgctgtccaaacgcccgatggatcgcgtggccaagccgctgcgggaaatgggtgcagtgatcgagactggtccggaaggccgcccaccactgaccatacgtggcggtcaagcgctcaaaggtctgacttacgcattgccgatggccagtgcgcaggttaagtcctgcctgttgctggctggcctgtatgcacagggtaaaaccgcggtcaccgagcctgcaccgacccgcgaccataccgagcgcatgttgcgtggttttgggtgcccagtggcggtggagggcgctactgcgtcggtggagccgggccataaattggccgcgacccacattgaagtgcctggggatatttcgtctgcggcgtttttcctggtggcggcgtcgattgccgagggctccgagttgctgttggagcatgtcggtgtcaacccgacccgcaccggggtgatcgatatcctgcggctgatgggcgcagatatcaccttggaaaacccgcgtgaagtgggtggcgagccggttgctgacttacgtgtacgtgctgccaagctcaaaggtatcgagattccagcggcgctggtgccgttggcaatcgatgagtttcccgtgctgtttgtcgccgctgcctgcgccgaaggtcgaaccgtactacgcggtgccgaggagctgcgcctcaaggagtccgaccgtatccaggtcatggccgatggtctgttggtcctgggtgtgaagtgtgaagccacggccgatgggattatcattgacggtggcccgatgggtgggggtgaagtgcaggcccatggtgatcaccgggtggccatggcgttcagcgtggcttccctgcgggccgaggcgtcgattcgtatccgtgactgcgccaacgttgctacatcttttccgaattttcttacactgtgtgcccaagtcggcatccgtgttgcccaagaggctcaattgtgaatatcaaagcaccggtgattaccatcgacgggccaagcggctcgggcaaaggcaccatcgccggcatcctggccaagcgcctgggctggtgcttgctggattccggcgcgctttaccgcctgctggcgttcgcggcgcgcaaccatggcgtcgacctgaccaacgaagaatccctcaagctgctggccgcgcatctggatgtgcagttcgtcggcgcgacggaaggtcatccccagcgcatcatcctcgaaggcgatgatgtgaccgatgacctgcgtaacgagcaagtcggttcctgggcgtcccaggtcgccgcgctgccggccgtgcgcgatgccttgttgcagcgccagcgggcgttccaggaaccgccgggcctggtggccgatggtcgcgacatggggacagtagtgtttccggacgcgccgctgaagattttcctgaccgccagcgccgaggagcgggcgcgccgccgctacttgcagttgaagggcaaagtcgatggtgttagtctgtcgagtctgctagatgagatccgtgcacgcgatgagcgtgatacccagcgcgcagtagccccgctcaagccggcggctgatgccatacagctggattccacggagttgtccatcgagcaggtgctggaacgcatcatgagcgagatcgccattcgcgacatcgccgggtgaccaagaaggctgcaggggaccagtcatagtcctgtggtgcttcttctaattgaaactgacccataccgtctggggtgtggagatgggcgtattcttcgcccttatcaacaggaattaaaatgagcgaaagctttgcggaactctttgaagaaagcctaaaaaccctgaaccttcaggcaggctccatcatcaccggtgttatcgttgatatcgattaccaagctcgctgggtaaccgttcacgctggtctgaagtctgaagctctgatcccgctggaacagttctacaacgatgctggtgatctgacaatcaatgtcggtgacgaagttcacgttgctctggactcggttgaagacggtttcggtgaaaccaagctgtcccgtgaaaaagccaagcgcgctgaatgctggattgttctcgaagcagccttcgcagctgaagaagtggtcaagggcgttatcaacggtaaggttaagggcggcttcactgtcgacgttaacggcatccgtgcgttcctgccaggttctttggtcgacgttcgtccagtgcgcgacaccacgcacctggaaggcaaggaactcgaattcaaggtcatcaagctcgatcagaagcgcaacaacgttgtcgtttcccgtcgcagcgtcctggaagcagagaactccgccgagcgtgaagctctgctggaatccctgcaggaaggccaacaagtcaaaggtatcgtcaagaacctcaccgattacggcgcattcgtcgatctgggtggcgtcgatggcctgctgcacattaccgacatggcttggaagcgtatcaagcatccttccgaaatcgtcaacgttggcgacgagatcgatgtcaaggttctgaagtacgatcgtgagcgtaaccgcgtttccctgggcttgaagcagctgggcgaagatccatgggttgctatcaaggctcgttacccagaaagcactcgcgtaactgcgcgtgttaccaacctgaccgactacggctgcttcgcagagctggaagaaggcgtggaaggcctggtacacgtttccgaaatggactggaccaacaagaacatccacccttcgaaagtcgtacaagtcggcgacgaagtggaagttatggttctggacatcgacgaagagcgtcgtcgtatctccctgggcatcaagcagtgcaaatctaacccatgggaagatttctctggccagttcaacaagggcgataaaatctccggcaccatcaagtcgatcaccgatttcggtatcttcattggtctggacggcggcatcgacggcctggttcacctgtccgatatctcctggaacgaagttggcgaagaagctgttcgtcgtttcaagaagggcgacgagctggacaccgttatcctgtcagttgacccagagcgcgagcgcatctccctgggtatcaagcaactggaaagcgatccgttctccgagtacgttcaagagaacgacaaaggcgcaatcgttaagggcactgtgaaagaagttgacgctaaaggcgccatcatcactctggccgacgatatcgaagcgactctgaaagcctccgaaatcagccgtgaccgcgttgaagacgcgcgcaacgttctgaaagaaggccaggaagtagaagccaagatcatcagcgttgatcgcaagagccgcgtaatccaactctccatcaagtcgaaagacgaagttgaagagaaagaagccatccagagcctgaaagccgctccggaagctgaaaaaggcgagaccaccatggcctccctgctgcgcgaagcaatggctaagcagaactaagttctgtaaagctatagaaaaagggcgacttcggtcgcccttttttgtgcctgaaatttgatgaatcaacaacatagaaccaaggcgttcagctcaatgtcagaactgactatagtcttcacgaaggctattcgtattgctgacctataagggcttgaatgaacaggattattgtaatactcgcgttgatggtgcttgcaggttgttcctccaccagtgccaagacctacgccaagcgcggcgccagcggtatcgaaatcgactgctcgggcctggggaataagtgggagaagtgcgagaggcgtgctgcccgtgagtgcaagatgcagggctacaaggttgtaacacgctccagtgatgccaaggacgaagagggtgactacttgttcggttggaacccagcaggtgccgtgactcggaagatgttggtgatctgcaaatgagggtgcccgcgcttgtagcaggtgtttattttgcccgcagattagttgacgcatgggctgttcaaattcatcaagtcatgctaaaaccttcgaagcgcttttcctagctgcttgaaaaagaagggaaaaatatgacgaagtcggagttgatcgaacgaattgtcacccatcaagggctgctctcatccaaggatgtggagctggctatcaagaccatgcttgagcaaatgtcccaatgcctggccaccggagatcgtatcgagatccgcggcttcggcagcttctcactgcactaccgtgcgccgcgcgtaggccgtaacccaaaaaccggccaatccgtcagcctcgacggcaaattcgtaccccacttcaaaccgggcaaggaattgcgcgatcgggtgaacgaggaagaggaagaaggcgtctgagtgtttttggggtaggagaaggttatgcgtggggttaagcgcgttgttgcggtattgattgcagtgctggcggctttggtggttttggcgtttgtgctggagaaccagcagagtgttgcgttgacgttcctggggtggagtactgcgcagatgccggtggcggtgtttgtggtggtggctttgattatggggatgttgattgggccattgttgggggtgtttgttggtaggcgtcggggtagggcgattgcttaggatttgctctctgggtcaggtgtgataaggaggtggcggcgctggggtgaccgtttgtcagaaacctagtcatgcagggcgcttcaagctgcctagctacctatccccgttggttccgacagttttcctagaaaagtcagaatcgtccgacatacatgtcaagacttgtaatatgccaaagagatggcagaatggaatctgttctcgataacaggcattttgtgcgctcaaaatttggcagagacgctgggttttggcggtcaaccaattagaataaaaaaacgcaattttgtctgcataacgagcccgcagtttctctttgaaggcaggtttttgttgtgagtagtagcttccgcgccccccccgcccctcccactcccccgtcgagggagattgacgttgtcgagctttcccaagcgatttggaaagagagaaaactgattttatctgttgctatatttgcaagcttgttggctgccgcatacgcgtttattgccacgcctgagtatcgggtgacaactgttttgcgtccttctgctatcaacgcgctcgatgccctgaatcgctcggaaatttataggctcccgccagacgaagctctgacgaaggtgggtgcttctctggagtcgtatgagactcgtcttggtttctttcgagaacatcagaagctatttaagtcatttgaacagcctggccgcaccctggaacagtcttttgaagcatttaatcgtaattcagtcagacttttatccagcgatgcaaaaaaagcggactcattgaatgcctatattcaaatggaaatgaactacccgaaaggggtggatggtgttgctatcctcaacggccttgtagattacgccatcacgagagagcgaaatcagattgctgcagaccttgatgtgattgtaaaaaaccgactgaatgagattaaaggcaagctggatgctgcccgctcaggttacaacgctgaaaaagaagcgaggatcgctcttttgacggaggctgacgcgctaaggcgggcgcagctgcaagacgagcttaaggctctgaggatacagttgaaaacgcgccgtacggatcgaatggcgcagctcagcgaggcaataggaattgcaaagtctttgggtattaggaaaccatctaccccgtcatcgctgggagagggtgaacgaggtgaggcagtcagcatgatgcgcactgagattaacaatcagcaagtcccattgtattttatgggtgttgacgcgttagaggctgaaagggcggcattattgcagcgcaagtcagatgattttacagagcagcgtattgcgcagatcgccaacgaacttcaattgcttcaatctaataggcagatcgaggtattaaatcagaggaagaacgaggatctatttcttaaaggtgtagagcctatgcgtgcagaaattgctcgattacacaatttgaatatggatatggggaacttacaactggtcgctatcgataagcaggcagttgagcccacgagtccaattaagcccaataagcttctaattgtcatcttgggagccttcctcggggtgttgctaggaatctttagtgctgtatgccgctattttttaaatttgagaaattgtcaggataggcgagcagctggattcagccttcccgctgtggaaagcaccttgagccatgacagtgcccagcctgcgcttttcgacgccacgcgttagtcggcgagttagtgagggctgcgtttgattcgtatggtagtgtcaagggactgcttgaatgactttatatatcttcgctctggttgcgacttgatatcattttgatgtcagttttggttctgctcatcaggcttgcttttttagatgattttttaaaccagtgagcaatccttggaaccaaatatggcctaaatgcctcaaatctgggaccgggccagagcgggcgtgatcttggtgagcgaccgaatgctttgagtttgctggggcgacatgggagcgactgacggccgtgtgtaaccccaacgtcgtttcactggattttttgcaagaatatttcataggacagcctgtcccatcgcttctggggggggctgatgcagtctcaagctgcatcagcaccgggaatatcttgggagtgtcaaagcatgctctggttgaattgggtgttcagggtagtattatctgcgtacgaacttatgatcttccgcagtaggtcgagttgacgggcgtgggagcacgtcctatttcaaagaaatggccggtatcagatgtcaatatggtctgacaaatacacttggcgatgcaaatgtaatagcatgccatggaaaacgacattcgtgaaaacgctatgggtgtagataaccactcaatcattctgcggcccaataccccgttgcgttacgattggtacctggtgcaatgcaagcctaagcaagacgggcgtgctcaggagaatctcgagcggcaaggctatgtatgctctcgcccagttctcaggcgcgaaagggtcagtcgtggtcggcgacagttcattacggagtcactgtttcccgggtatttatttgtacacctcccggaaggtgccaattgggccccgctacggtcgacaaagggggtcagtcgtatggttgcttttggcggctccccgctgggggtagcgtctggccttgttcatgcgctgcaggagcggggaaatttgggtgttgttcctacgtatcatgcgggtgataaggtagttatcctcgatggcgatttctccggctttgagtccattttcatggcgatggacggtgaggagagagccattttgttgatcaacatgttaagccgtcagcgacagattgttgtccctttgagctgtctaggtgaggttggcagcgaggcgtgactggcgtatagcagcaggcgagtcttcagggggatgactaaaaaccttggggcggtagcgtgggattattttattttcctcgctctctggtgcacaaataacctgtgtcagaattcaggtaaggctaaaacctacggctacaccgcccggtgacatttttcgcgagacacgttccctagccaatacgagtgtaatcgactattcgatttaaatttaccagtgcgaagctgaaatagaatcgcgcttttcttatggaactaacacatgttgttattagaaaacataaaacttgctattgttggtttggggtatgttggcctgccgttggctgttgaattcggaaagcaccgctctgtcgttgggtttgacatcaataaatctcgcattgagtcgcttcgaggggggcatgattcgacgctggaagtgagtgatgatgaactgctttctgcaaaatctctcagttttagctcagatttaaatgaacttgaaaaatgtaacgtctttgtcgtgactgttcccacgccaattgatgaatacaatcagccggatttgactcctttaatcaaggcttcggaaagcatcgggaaggtattgaagaaaggcaatatcgttatttacgagtcgaccgtctacccaggtgctactgaagaagactgtgttcccgttttggagaagttttcgggacttaaatttaatgttgatttttttgcaggttatagtccagaacgaattaacccaggtgacaaggagcaccgcgttactaccattaaaaaggtgaccgcgggttctactccagaagtggctgatcttgtggacttgctgtatcgcgaaattattgttgctggcacgcataaagcaagtagcattcgtgtcgcggaagccgctaaagttatcgaaaatacgcagcgcgatttaaatattgcactgattaatgaactggctattatttttaataaaatgggtattgatacggaggctgtgctcgaggctgccggtaccaagtggaacttcttgcctttccgtcctggattggtaggggggcactgtattggcgtcgatccatattatttgactcataaagctcagtccatcggttatcacccagaaattatcctagcagggcgccgtttgaatgacagcatgggggcatatgtcgtttcgcagttggtaaaagcgatgctcaagcagcgtattcatgtcgacggtgccaaggtgctaattatgggcttggcattcaaggaaaactgccccgatctgcgtaacacgagaattgtcgatatcgtacgagagttggctgaatacaatattgctgtggacgtgtatgacccttgggtaagtggcgctgaggcagaacacgaatatggcataatgcctatcgatagcccggttgaaaacacgtatgacgccgtagtagttgcggtggctcataatgagtttcgatctatgggggctgctaaaatccgcgcgctcggtaaagacaaacacgtactttatgacctgaaataccttttggaacgtggtcagtctgatattcgtttgtgattgtattttagatgcctacatagtagtgggcaatttttagactctctttctctacgaagtggaccctatgacgcgttacgaaatactcttgaaaaaccttccaaatgagccaaaagtttggcttgttaccggagtcgctggttttatcggttcgaacttgctcgagacgcttttgaagttggatcagcacgtggtcggccttgacagttttattacaggacaccagcggaatctcgatgaggtaaagcagagcgtcgatgaaaaacagtggctcaggttcaaattttttaacggtgatatccgaaatttggatgtctgccacgaggtttgttctggcgtcgattatgtgcttcaccaagctgctcttggttccgtgcctcgctccctaaatgatccgataactacaagccaaactaatattgacggctttctgaatatgttggtggctgcacgggatgctaaggtcaaaagttttacctacgccgctagcagttctacttacggtgatcacccagggttgccgaaagttgaagatgtgatcggtagtccgttgtcgccttatgcggtgacaaaatatgtcaacgaattatatgctgacgtgttcgcgcgctgctatgactttaataccattggcctgcgttactttaatgtgttcgggaaacggcaggatccagacggtgcctatgcggctgttatcccgaaatgggcggcctccatgattaaaggcgaaaccatctttataaatggtgatggtgaaacaagtcgcgatttttgctttatagagaatactgttcaagccaatttgttggcggctactgcggtcgaccaagctgttcgcaaccagatttataatgttgctgtcagtggtcgcacgacacttaatacgctgttttacgctctaaaaaaagagcttgcggcaaatggtgttgattatctgaaggatccgatatatagagattttcgtgctggtgacgtgaggcactctcaagctgacattggaaaaataaaaaccagtcttggttactcaccggcctatttgattgagcatggtgtggcaaaggcgatgccgtggtatgtcacttttctaaagtgatgtcgaaggatatatagcctgctaatggttacgagagggtatgatgagtcttattaaatggatagatttccagacgttaggtgatgagcgaggcagtctggtttcgatcgagcaaggtaaggtcgttccgtttgagataaaacgtgtttactatatatatcgaacggctgaaggcgtaagtcgcggctaccatgcccatcggaacttgcaacaagtcgctatatgccttgtcggcaagtgccgtatggtattggatgatggtgtgacgcgagaggatgtttggctggattgcgcaacaaaagggattttgattgaaggtggcatgtggcgtgaaatgcatgacttcagtgagcagtgtgtactacttgtcttggcaagcgcaccttatgatgaagcagattacattcgaaactacgaagagtttttagctattacacgccagtctagaatagcaacctctttgcagtgttaagttaccttgccatcgtttaaacttgtgaactcatgcgcgatattgatatggtgatgtgcaaattgttataagtttatacagtgtgttgtattacatcagcggttgtatacttgtcttgttcgccgccttagaaactaatcaggttatataaagatggtaaattttctcgatttgaaaagcattaacgccgcgctgcgttcggagttaattgaggcatgtactcgggttattgattctggttggtatatatcgggtcgagaagtagcggcgttcgaggctgagtttgcagcgtattgtggtgtaaagcactgcattggtgtggcaaatgggttggacgctctgacattgaccatacgagcttggaaagtgcttgggcgatttaagcagggtgatgaagtcatcgttccggctaatacctacattgcgagtattctatcgattacggagaacggtttggttccggtgttagtagaacctgacgacactaccttcaacttgtgtcctacgaaattagaaggcgctctcaccgatcgcacgaggttgatattgccggtacatctttatgggcaaatttgcgatatgccagctattaatgaattcgcacaaaaatatggtctgttggtactggaggactcggcgcaagcacacggtgcaagcgtgaaaggtaaaaagacaggtagctggggaagcgcttcagcattcagcttttatccgggtaaaaatcttggtgccttaggagatgctggtgctgtaaccacagatgatgatgagctcgctgaaactattcgagccttagggaattatgggtcgaaatcaaaatataataatatctacaaaggcgtgaacagtcgcttggatgagttgcaagccgcaatgttacgtgtgaagctgggccacttggaaaaagatacgagtgtgcgtcgcagtattgcagctgcctacatggctggtatagaaaaccaagcgttgaagttgccgcttgaaaagtctattgatgccacctccttcttggagcatgtttggcatctgtttgttgttcgttgtcaaaaccgaactgcttttcaagatcatttacgtgctaagggcgtggagacgctaattcattatcctattcctccgcacaaacagaaggcttatgccgaatgggatgaattgaattttgatatcaccgagcgcatgcacgccgaggtcattagtctcccgattggaccgacgatgagtatggacgacgtttccgtcgttatcgacgcatgtaatagttttaacggcgccacggtagaatgacgtttcttaaaaccagtctattgaatggtatagcagtagttgtacgcatggtcacactattatgtataaataaaattcttgcggtatacgtcggacctgtaggctatgctgcgcttggccagtttcaaaatgcagtgcagatgatcacaacgtttgcaagtggcgcaattaacgcaggagtcactaaatacaccgctgagtatcatgaagatgaagagcggcagcgcacggtgtggcgcacggctggcagcatttccgtgatcggagcgctggtgaccggcgtgctcgtgaccgtttttaatgaaaatttatctttggcttttttgaaagatcgtgcgtttggcggtgtatttgtttggttttcagcaactttagtgttgtttgttctgaatactttattgcttgcagtactaaacggtaagaaagaaattcctcggtatgttatatcaaatattgcggggagcctttttgctctggccgttacagcgtatatggcgattatgtgggggctgtatggcgcgttggtagcattggcggtttatcagtcgttgagtttctttgttacagtttttctctgctatacagctccttggttcaagattcgatattttatcggacgaattgatttcggtgtggctcgaaatttggctaagtatacggcgatgtcactcacctctgtggcgtgtgtgcccattagtcaaattctggttcgaaatcacttgggcgagagcttcgggtgggaggcggccggttattgggaggcgttgacgcggttaagtggcgcttatcttatgctgatcaccacaacgctaagtgtttattatttacctaagttctccgagttgaaaaagtcggaagatataagggccgaaattgtgagtgggtataaaataatattgcctctcactgcggcgggtgctctgataatctatctttttcgcgaaatgatcgtgaagctgctttttactcctgaattcttgccgatgactgatctatttgcctggcagatgctaggcgatacattgaagatcggaagttgggttatagcctacttgatgcttgggaaagcaatgttcaagcttttcatgatcacagaagttattttttctacttctttcgtattgttgtcttggctgtttaccaatgaactagggttgcagggtgtgacagtagcctacgcaatcaattacgcggcgtactgggttgttatgggtgtttgcatgtcacgcaaattgaaggcagttcaataaatatttataaatgagctaagcatgattacgcttgtgataccttcgtataatcatattaattatgtgtttggttgcattaaggccgctctggcagtcgatttgccagggcggaaagttgttgtaattgacgatggctctacagatggttctggcgaagccattgaatcctttatttcaagcttatccgatagtactatcgagtttatatccaagccaaacggggggcttgtttcatcactgaacctcggattagcgagggcagatatggagtttatttacctagttgcatctgatgacatcccagagccggccgggataaaaaaatgtgtcgataagttaatcgcaagtccgaacgcgaaattctgtatcggtggcggttatgctttctttgataaaacacctgaaaatagagtgcccatatacggggttgctcaggatgatttctttagtctgagccctgatgcaatgagtcgcagtattttcttgaattacccctctccaatactattgcaatctaccgtttttaaaactgactctttgagagcaattggtggctgggatccgaagttaatgttagacgattatcctacttttataaagttattaacgcatttccctattcgcgatgtggattttctttttgcacctgaggtaagtgttgttgggtatcggcaacacgaatctaatagttataaaaatgtaaagaggcagtattttatggtgcgtgagttgatggaggaacttgctccggattatatacagcgcaaagcaattggccgtatcttggcttcttatgtcatttcggctttgaagaacggtgacttcgccacagcactcgtaatgctccgatcgtcaaaatttatgcacgttgttgcggccataccggctgcgataagtttggtgggaaagagagtagcaagaaagtctaattgatagctgagctcggtactgagcttgcctacacctttggttttactagtagttgttaggcggtggtttaattgagattattttttaagaatgccttagtgtcacctgtcttcgtcttactgttcattactctgctaatgtattgcgctaacttgttggctcttgagcagccttgggagtgggggcacagtgtttatttgttgggcgttctatcttttgtaatcgtttacatgcttgtatatgtatcgttgtatttaggcggtatcccgcatcccaagtctgagctgatctcaccctatagaataattatccaactctattggctttgtgctttttttggtttagtactgtctctttacaagatttatgcgttcggctataacggaaattatggtagcgttttgttagcgttgagaatcgcgaatacttgggagcaccagccctcttatggggctcagcactttgctctgttcgcactgtgtttgtcgctttactacgcacagcaaaaacgagctttaccttgcctagtagcagcgcttatttatttgacctcggctttcagtatggcggagagaacaagtatgatgtttatatttgtcgctgtgggttataccgccatcaacgaggggtggataaggctgaaggggctactgctgtctttagccgttttaataggtttgttcatcatcgttgccgtcggaaccgggaaaactggtggagataaggggtatgactttatcctgttgtacctggggtatgctgtgacagccttttcacaatggacagagggtaaggactatttaggttgtgctgatctggtgtttgggaaatttattgatctgatgtcgttgggattatactcttgtccgcctcttgatcttggtctaactgataaagacttcaatgttcttacctatgcagcgtctccatacttattcggtgggctaccggctgtcataatatgtatggcaattgtcggtgctttttttgcgattcttcgggtttttgcagttaagagaaaaggatattacttggcaattcttagctgttttatgtatgcgttgatcatgatgttttatgcatggcaattttcattgactacctatttatatttaatggcaatactttttcctctctttgcggggaggttccttcacccgagtgggcagaaaatatccccgtgatcattgcatcccgtgagtgagctccaggcgcgattggctacgcaacggataaccgtaaaattatttgagctgttgagatcgaaatgaaaattttattacttccaaaatattctcgtatgggagccagtacgcgtcttcgaacgcttcagtttttgccttttttggaggctgaagggtcgcaagttgatattcagacgttgtttgatgataagtatcttgaaaacctttatcggggaaacggcagatcgtttgttttaacgtttaagcaatatattttgcgtttcgctctgctgttcaaggcggcgcgctatgacgttgtgtggatcgaaaaggagatatttccattttgccctgccttcgctgaaaggttgttaaagttgttcggtattccgtatatcgttgattacgatgacgcggtttttcacacttatgatctttcttcgaatgctttggtccgggttcttttaggttccaagattgacacagtgatgcgtcatgcaggatgtgtagttgcaggcaacgcctatcttgcggaacgcgcgataaaagcgggagcggctaatgttgaggtgataccgactgtggtcgatcattctcgctacgcgagcacacttacaccccctaataagaaattagtaataggctggattggttccccgtcaactgaaaaatatgtcgtccaaattcgagatgctctcaggttagcatgtgaaacttatggtgctcgcgtagttttgatgggggctagtgagggcgttatcaacgaacttgagggtattgacgtggaggtccaagcgtggagcgaatatgcggagacagggtttgttcaggcactcgatatcggaatcatgccactgattgatggactttgggaaaagggaaagtgtgggtataaactaattcaatatatggcttgcggagtgccggttattgcgtcacccgtgggtgtgaatgttgatattgttgaaagcaaccagtgtggaatgttagcaacagacatgtcggattggcatcgctgtcttcatacactcctgggcgatcgggatttacgtcttttttatggcagcaaagggcggcatgcagtagaaaatgtcttttcggtgcaagttcaagctccgcgaatcagagatatactcgccgtggcggccagtcgggcaggttagtgtaataagttcttgggtactgttgccgatggtcttgttatctcaatttaattatcaaggcttctctcgcgcttactttcgcggccttaatcgggattaattaaaatgtgtggattaagcggtcttttcgatccgtccaagcgcgctgagcttcacgatgttatctccaaaatgaacgatgccatagcgtatcgcgggcctgatgattcgggtatttggattgatgacattggacttgcgttgggacacagacgactggcgattgttgacctcaccagcgcgggccaccagccgatgcattcccacgaccagcgctatgtcttggctttcaatggagagatctataatcatctcgcgttgcgcaatcaacttgagtcagaaggtagtagtactccttgggcgggccattccgataccgaagtcttgttggcatgtcttgctcggtggggcatcgagaacgcgctgaagtcgctggtcggcatgttcgcgtttgcgctttgggataggcaagagcaggtattgactctggctcgtgatcgagtgggcgagaagcctctttattgggggtggcaggataatactttgctatttggatctgagttgagtgcggtgaaggcgtatccggagtttaaagccgagatcgaccgtaattcgctctctcttatgttacgccataattgtattcccgcgccttacagtatttataagggcatttcaaaactccgtgctgggcactacgtgtctttgagcctgagtgatattgccgctgcaaagggttccgtatctcaagcctactggtcggtcaacgatgccgttactgcagggctggctaatccttttaagggttcgccgaaggaagcgaccgacgcactggagaatcagctccgactaagtatcgggcagcagatgttggctgatgttccactcggtgcgttcttgagtggtggcgtcgacagcagcacagttgttgcgttgatgcaggcccaaagcaaacaatctgttcgtacctttaccattggctttgacgaaagtggttatgacgaggcggtccatgcgaaggccgtggcaaagcacttgggaacacagcatacggagctctacgtgcgccccaatgatgccctcgcggttatcccaaagcttgcatccatgtactgcgagccgtttagtgatagttcgcaaattccgacattcttggtcagtcatatggccaggagagaggttaccgttgtacttagcggtgatggcggtgatgagctgttcggtggctataaccggtatctaacagcgcggcaggtctggcagaaaatgcatcgcttgcccggttttgcgcgcagtgcgactgctaaaatgctgcgtgctttatcgccgagtgcatgggatcaattgtttcagttgagtaagcctatgctgcccaaacgcttgcacctagcgacccccggagataaagcgcataaactggcctcggtactcggtattgccagtggcgaagacttttatcatcaactgaacagccattgggacgaccctgctagtgttgtaatcggagcgcatgaaccggaaacgctattcaccgacaaagtcacatggcctgtaaccgatagctttgagcattggatgatggcgatggacatgcagacttatatgaccgacgatattctggtcaaggtagaccgcgcatcgatggccgtcagtctggagtcgcgcgtaccaatgcttgatcatcgagttattgagctagcttggcgcatgcctctggacctgaaaatccgggataatcagggcaaatggttactgcgggaggttttatatcgctatgtgcctaaagagcttattgagcgccctaagcagggctttggtatcccactggacagttggctcagagggcctttgagagaatgggcggagaatcttctcgatgaaggacgcttgcgtcgagaggggtactttcatcctgagcccgtccggaaaaagtgggcggaacacttgagcggacgtagaaattggcagcatcacttgtgggatattcttatgtttcaagcttggctggaagagcaataaaacatgaattttctattaatcgccagctatcctgattctttgatcaactttcgcgggcctttattggacgcgttgcttgctagaggcctgaccgtgcatgtcgcggcgccggatctttcttcggatagctctgtgaggatgcgtctggaagagaaaggcatgatcgtgcacgaaattccgctgcgcagagtcggcatgaacccttttgccgactttttcaccctcatttcgctttgtaagttgatagcgcgtgtgaaaccagatgtcgtcttggcttatacggtgaagccggttatctatggtttgctcgcggctcgattgatgaaagttcgccggcgttttgcgctgattaccggtctaggttatgcatttcagggatcgagtaatggggaaggggagcgccgtggtttgcttcgtgccttagtgcaacgtttgtatgctgtatccctgcgatctgcgacccgagttttctttcagaaccccgatgaccaggcgttattccaacaactcagactgatcggatctgaaacgccttctactgtagtgaacggttcgggtgttgatttgggcgactttaatgtcgtccccctacctggaaaaatcagctttctcttgattgcccggctcctcggcgacaaaggcgtgcgtgagtttgtcggtgccgcgagggccataaaggctgagtatgaacatgtcgtgttcaaggtcgttggatggatcgatgaaaatcctgatgcgattctgcaagaagaactggatgcgtgggtcggtgatggtacattggagttcctaggtcgcttgcaggatgtcaggccggcaattgcagactcgtctgtttatgtattgccatcttatagagagggaacgcctcgcaccgttcttgaggccatggcaatgggcagacctgttatcaccacggacgctcctggttgtcgcgaaacagtggctgatggggaaaatggttttttgataccggttaaggatgtcgaaaggctcaccgctgcgatgttgaagtttattaactcgtcagagcttatttcgagtatgggaaaaaaatctcggacgttggcggagcttaagtatgacgttaaaaaagttaacgctgttatgttgcagggaatgggtatttaacagtattggaaatgctaattcgtttattgactttgcctgaaggcctcagtgaaaggtgctgcaatagcgttgaagcctgactataatctttgttgagataaaaatgcttaaacgttcatttgatatttttgcttccgtgtgtggcctgattttatttggccccgtcatgatcatagtcgcatggctggtcaaacgaaagctcggttctccagtgttgtttagtcaaataagacccggtttaaatgccaaacctttcaaaatgatgaagttccggacgatgcttgacgctgtcgaccagcatggcaatccgttgcctgacgcgcagcgtatgacactcttcggaagcttcttgcgctccagtagtttggacgagttgccaggtttgctgaatgttctgaaaggagacatgagcttggtcggacccaggcctcttcttatggagtatttgccgctgtacagcgccgaacagtatcgccgtcattgcgtaaggcctggggtaaccggctgggctcaagtcaacggtagaaactcggtaagctgggaagagaaattcaagctggatgtttggtatgtggataataattcgctatggcttgacctgaaaattattatactgacgatcaaaaaggttatcgtcagggatggaatcaacgctgatggcgaagctaccatgagtaagtttacgggatccaaataaataagcgggggagcttgggtggaagggatattctgaccaagcgtttgagtttcttaactttgtcttgataaaatttaaggtgttatttatgttgggaacatcattttccccctggccctcgttcaccgaagaagaggccaacgccgttcgtgatgtcatactgtccaacaaggtcaactattggactgggcaggaagctcgccagtttgagcgcgagtttgcctcttggtcaggcaccgattacgcgattgcacttgccaacggcaccgttgcgctggacctggccctcatcgcgttgggcataggtgaaggcgatgaagtcatcgtaacgtcgcgaacgtttctggcctcggtttctagcatcgttaatgcaggggccacacccatttttgccgatgtggatcgtgactcgcaaaactttacagcgcaatccattgaagcggtgttaacgcctcgcactcgtgcagttatttgtgtgcatctcgcgggctggccgtgcgatatggacccaatcatggaccttgccgctcagcatgatttgatggtcattgaggattgcgcgcaggctcatggtgcttattacaaaggtcgtccggtcggttctatcgggcatgtcggtgcttggtcattctgtcaggataaaatcatgacgacgggtggcgagggggggatggtgaccactaacgaccgtacgctctgggttgatatgtgggcttataaagatcatggcaagagttgggaagctgtctatgagcgtcaacacgcccccggttttcgctggctgcacgaaagttttggtaccaactggcggatgttggaggtccaagctgtcattggcagaattcagttgcgtagaatgaaggcgtggcaagctctgcgcgagcagaacgccacccgtatatgggacgctgctcgtgagctaccagcattaagggttccactgttttctgaggatagtgttcacgcagcttataaatgctacgtgtttgtacggccagagcagttaaaggacggctggtctcgggatcgaatactgagcgaaatcgcggcacgtggtgtccccgctttttcaggctcttgttccgaggtttacctggaaaaagcattcgataatactgggttgcgacctgctcagcgtctggcaaatgcaaaggaattgggtgagacgagtatgatgttcctggtgcacccaacgttgacccgcgccgaaatggacctcacgtgccaagtaataatcgatgtcgttacagaggcttcgatcggatagcacttgtggatgtgtcactgcgtatgtgtatgaatgaacggtttggttggtaccggagaggtgtttaaggtatatatggatagcttacgaacgtatttgttgagtcttccacgacggcagaagcgtattttgcaagtggctacagatgttgttctggtctgggccgcgctgtggttggcgtttgtcgttcggctgggaatggatgagatgagcaatccggtcaagcttcatttgtggttgttcatatgtgctcccgtcgttgctgtcccattgttcattcgcttcggcatgtatcgggccgtaatgcgctacttcggcaatgatgcccttatcgcgatcgtcaaagccgttagcctttcatcattagttctagggtttgttgtttattggtacagcaaccatcagagcgttgtgccgcgttcaattattttcaactattggtggctcagcctgatcatggtgggcggtttgcgcttggcaatgcgccagtatttcttaggtgactggtttgctgcggcccagcatgtaccattcacaagccgtgaagatggtctgcctcgcgtggccatatatggcgcaggtgctgcgggtaatcagttggtagctgctttgcgcatggggcgtgttatgcgacctgtcgcatttattgacgacgacactagtatttctgatcgagtaatctccggcctgcaggtctataaacctaaacatattcagcgaatgattgatgctactggcgctcaggaaattctcctggcgattccttcgtcaaatcgagctcgtcgccgagaaattttggggtttctcgagtgttttccgctgcacgtgcgaagtgtgccagggtttatggacttggccagtgggcgggttaaggtggatgatatccaagaggtggatatcgctgacttgctggggcgagatgctgttcccgcacaggatgagttgctggagcactgcatcaaagagcagtgtgtgctggttaccggggcgggcgggtcaatcggttcggagctatgccggcagattttgtcgcttcgtcctaccacgttgttactgtttgagcacagtgagtttaatctctacagtattttgtcagagctcgagcagcgtattacccgtgaatccctctctgtacgtctgttgccaatattgggttctgttcgcaatgagggcaagttgctggacgtcatgaaaacctggcgtgttgacacggtttatcatgctgccgcctataaacatgtgccgatggtcgaacacaacattgccgaaggtgtgatgaataatgtgatcggtacgttgaatactgcccaagcagcgctgcaggccggtgtttcaaactttgtattgatttcaaccgacaaggctgtgcgaccgaccaatgtgatgggtagtaccaagcgcctagccgagttgacattacaagccctcagccgtgagttggcacctgtcttgtttggggatacgacaaagatcctgcgggttaataaaacgcgcttcaccatggttcgttttggcaatgtgcttggatcgtctggctcagtgattccactctttcacaagcaaattaaatctggtggcccgctcaccgttacacatccgaaaatcacccgttatttcatgactattcctgaagccgcccagttggtaattcaggctggatcaatggggcagggcggagatgtgtttgtattggacatgggagaaccggttagaatcgtcgagctggccgaaaaaatgattcacttgtcagggttgagtttgcgcactgaaaaaaatccccacggcgatatcgcgattgagttcaccggtctgcggccaggagaaaagctctacgaggagctgctgataggcaataacgtcgttgccacacagcaccctatgattatgagtgccaatgaggatcacattgcttgggacgttcttaagatcaagctgacagagctactttcggcagtagatcaggacgattacgctcgtgttcgccagttgcttcgagatacagtcagtggctacacacctgatggtgaaattgttgattggatttatcagcagcgccgcttggaaccttaatgtatagaacatgaatacgtgacggcgcgaggatacgaataaccggactatcatcatagtccggtttttttagtattcgtaaaacccagagttggtctttcgccccaacttgtttgccctgaccatcttcctcagtaaagggtgggctctgtattttggatcgcctgtctcgttgtgcagggtctccataatcgaaagattaacatcatttccgatcaagtccgccaaggcaagagggccaatgggatggtttgcgccaagcttcattgccttgtctatctcctcggcactggcgacgccttctgcgagtattccgatagcttcgttgatcatcggaatcaacattctgttgacaatgaatccgggcgcctcgttaaccaataccggctctttccccaagctttttgcgaaattgaacgcccaagtttcggtttctttacaggtagagaggccgacaattacttcgacaagcttcatgactggagcggggttaaaaaaatgcaggcctatgacattttccggtttttttgtaaggcttgctaactcagtaattgatagtgatgaggtgtttgaggctattagtgatgtagtgtccgcatactgtgcgatttcacggaatatcccgtgttttatggacatgtcctcggaaacagcttcaataatcaagtcacaattttttaatgcttcatagtggtgagctgtctggattttctgagagaatctcgaaacgtcttctgccgctaatctttttttattaatcatgcgctcccacagagcgttcaggttttcaaaagcttcttcactgcttgcttgagagcggcctatccagactatagaagcagtcgcatcagattgcgcgagtacttggacgattccctttcccatcgtgcctgagccgatgacggcaaccttgacttctttcatattaaatatattcctttactcttaggaagaccgcaatggttttgcagggtttccaaatacggtagtgtatggggcgacacttttggtcactactgaacccatgccaacgacagcaccttcaccgatcacgattggcctatccggtgtgccctgtcgaatcatcgcgccagtaccaatataggcatgattttcgattacgacgcttccattgcattgcacattgggggcaaacgtcacgtagtcaccgattacacagtcatgcgcaatgtatgagtaaaggttagcgtgaaaaaatttaccaatggttgcgttcgaagtaacagtagtaaaagggcaaaaaacagcaccctcgccaataatgttgtgactcagattaattgcgttcgatgctgagattgagaatggctttgcacccagttctatgaacctctcggcgatggtctgtctagttttgctgttggcgatcgtaatgttgaagaacttatcgccatccattttcataaagctttcggtatcgaccacggtataaccgttgatggccttgtcttgaaaatggtcatccacgaataaaatttcgaaattttcgtgggatgatatttcagtcatttgagtgacgaggggggcgacctctctaccaaaccctccggcccctacgattgcataaattttcatctttagctggtccttaagcttaatcaggattgaccttggctcaagcaattctacaggtgaatagtgtcagtgtcagtgtcaggagtagagttttacagcttgtctgaggcactcaggctggtttctcgatcgctcgttatacgccttttggggtggtggctgaatagtggcatggtctattaggcctctgccctggcacgtgccacccggctggccaaaaaactgataagaaacgcggtctgttaaaagtgacctataacactgcttaagctcaggtatgttttctaattgtcgatcgttaggagggcgtgcgttcggaatgccgagggctcagcctgggggcgcacgctctaccagcagacgaaagggtttattgctcagaaaactcttcaatccatttggacacgatatctttcggatagccgcgatggaagtgcctgcgccaagggtatgcgctttctcctgaaccatccttcagcttaattttgctagtattgcaaatcagttttgcgggagatccagcgactaccgtatcttgagctacatctcggctgacggagctgtgcgcaccgactaatgctcctcttttaaccgtaacgcctggcaggatgacggacattgtagcaatcaccgaaaactcttcgatcttaacgccggacattatttcgctcggcgggtgaggatcgttggttaatacaacataggggaatatccatacatagttttctattgttgaatgttgtcctatgtggacattgctatggcattttacgtaatttccaatttcgcagtgtccttgtatatcgccaagtgttcctatctgaaagcccgccccggcggtagtcagttctctgattgtaactctgtgccctgtcgtgaggttgtcaccaaacgaagacccttcataaaaaacacaatgtgaacgaataatggacgcttttccaataatcaacggacgtccatttgccagtttggttggtaagccaatttcgcagtaggcaccaatttctgtatcatcgccgatggttacgtttttatggacgatactataggggccaattttaacgttgctgccaatttttgcatcggggtcaataactgcggttgcatgtatcataaatttttccgctggtaaataagatatgaggggcgcttttgtagcagtatcaatgtgctaagctgacgtctaacggaaaatcatagtatctaattagtcgggagagatgaagcgctggcgccgtaatccgtgaagggctgtgagtcgctcctgccgtttccttcggcataagtggccgtttgagtgctaaccgcttgctgtccttcgattttttcacacggggcgggcggtgactgtgagaccgtcacatcatgcgagattgggtgtcggtggttcgtccagactagtgcgacagcggacattgaaggtgtgcaccagtgccgctcgagatgagagcgtagagatttcacaaaaggccgtaatatccattgagtcattctttatcggtacgtaacatacgccgatttttgatgccctacgtgaaccatcggcaatggttaagcatgtggttgaaaatcctataaaatttttaaaaataaccataattaatacggcgcacccatctatgcgagagcggttctcatatcatcacaatcagcatattgactaccgtccagatgttgacgggctccgcgcttttgcggttctggcggttgttatttttcatgcgtttccattggcgctaaagggtggtttcataggcgtagatatttttttgttatttcaggttacttgatttccaatataattttcaagagtttagataaggggcattttagctttgttgagttctatattcgtcgagttagacggatattcccagcgctgatccttatgatgcttgcctgctttacagctggttggttcttgttgatggcggtggagttcaagtttgttgggaagcacatcgcggccgggattgcattcgttcaaaatattatattgttccaagagtcagggtattttgataccgcttccgaattaaaaccgctgttgcacttgtggtcgctggggatagaggaacaattttatttgcttttcccgctcttggcattgtgcttatggaaggttagacgccttgccctctacgtattgattatatgcgtattgttgtcctttggtatcaatatcagcgatgtcaaaagcgaaccctcggctgctttctatttgccggtagggcgtgcatgggagctgctggttggtagcttgctcgcatatgagagtctatacaatagatgcacgctgactggggcattggcgtcatgtggcgtcaggaatgagttgactgagcgtctggcgccgttggttcgtaatgcgattgctgttgctggttttttactgctggtcgtcgcgctctgcactattcataaggggctgccttttccgggaggcatagccgttgcgcctgttttgggcgctgcgctgatcatcctcgcgggccctcacgcatgggtaaatcgcagcctattctcgcttcggccaattgtctggttgggtttgatcagttatcccctctatctgtggcattggccgattctaacctttctgaaaatcattaatgttgatatacctacgattggaatggttttggcggcggttttattaagtattgttcttgcggccgcaacctatctatttttagaaaagccgtttcgatcgatcgctccctccaagaaaaacagtgccatcctattactgctcggtgtaattatgggcgtggcagggggtactgtttttataaaaaatggtctgcctgaacgaatgcctgaacgcgaagcctttgctcagtactttgagaattcatggcctgaacaggcttatgttgccaagcatggtcttgcaaaaacgtaccgcttggagtgcgacttttttgacttcgatagctatcgtgaaggtcatcctaccaacgatcctatcgagcgtatcgctgagtcgtgttatacgccacagactaatacctccgtcatgatttggggcgattctcatgcacaacaactttatcatgggcttcgtgaagaaattccaagtgacgtttcgatcttacaagttgcaacgtctggctgcatggcttatttgccaaacgctgattatccaagagcgaaaaattgtgaaaagtctaatgcacttgctttgagcgtgataaaggaaaaaagaccagcggtggtgattgttgcccagttttctggactggataagtcgaatgacttaaaggcgctggcgagtcagctaaaaagttatggcgtgggcgatttaattgtcgtgggccccgtgcctcgctataatcgaccgctctaccagctgatcgttcgtaagtattggccagatccgccacgtaagatgaccactcattttatttcggaagttcaagaaactgatgagtctcttaaacagctctatggcagcgggcagggtgggtttgattatctttctgctcgagacgtgttctgtgacagtgaaggatgtttggcttatttaggcgcagatcctaaggaggggctagtaacgtttgattacggccacttaacggctgtcgcctcagtattcttatctagaagtacacttgcgccattggtgatgagcaagttgcatcgggcgtttgatagtcaaaaaattgatcctctgaaaatgagttatgagtgacagtatgtgtatgctgaatagaagtaatcacactctgtaacgtagccacttttgactctcgcccaacatcatctaggtttgagaagcagcttcggaaaagctgcttttctcttaccgatgtcatggagcgtcaccaatgcaaaacctctacatttcctccctcatcttcgccttcctcaccagcctctccgtcgccaccaccgctgcgccgttcatcaagccggaatctccaacccctatctccgcccaaatgaccaagaccgagcaatccaccaaggtcaacctcaacgccgccgacgcagaaaccctgcgccgcgatctgtttggtatcggcgcctccaaggcaaaggcaatcatcgcctatcgcgaaagcaacggcccattcacggccgtggatgaattgttggaggtaaaaggcatcggcaaggcgttgctggataagaatcgcgacaggctggttataaattgaggatgtagatacagcccagaaggccggtcattgaccggcctttccgttagcagggactcgcccatcgcgcaccattggcatgaaacgtgattacatccaactcaatgattgttcaacaatcctgaggtagtgatgacgctcagcatgtctttagccgatcaaatggccctggaactacgtgccgacataatcggtgggcggttattgccaggtatgccgttaatcgagaaggatcttgtcaccgcctacaacgcctcgcgcaacactatccgtgaggcgctgcatcgtctgggccaagagggccttgctcgctacgtccgcaataagggtgtaatggttcggcgcctggagcgggcagaagtacgtgacctcttcgtagtccgccgcaccctggaattgcaggccatagcccaaagcggcccgctgacggacgctcaatcagggcgtatgcagagcgctattgaggccaccaccctggctcgtgagcgtgaagattggcgagcggtggccacccacagtctggtgttccatcaacagattgttgcgttaatgggcagcccgctgttcgatgagtttttcgcccaggtgattgcccagttacgcctggtgttttgcgctgcacctgacgagcaacgtttccagtcgccctggctggagcgcgatcgagagatatacggcttattagccgagcacaacagaccagcagccagcgaggcgatgagcctttacctgggcgattctgaacacctttccctcgccttgtttgatcacccttgatggaggagtgccccatgtacaaagactatcccgccgcgtaccaggtcagcaaaggttcggcgttgcaggtggatacggcgttctatcagcgtattcgtgatcagaaaacccagcgcacattgatcgaacaattcgaggtaccgatccgtacgggcagggcatggaaagtaccggctgggcatgtgttccgtgtgaccacaccagttggaccgcaggtaggcgacttcaacgtatggaacgccaatgacccgcgcgagcgcttgtgggctgcgcgcacgaggcaattgcaaggcgcccatgtcagcactcacgaccgtctatggtcgaacctgccctttctaagacccttggtcaccatcaccgacgacagcctcgccaactacggcatcgatgagcacggcggccgcctgcacgatttgcttggcacgcgttgcgacccttatgtgaaccgtatgctaaccggtgaggacttccatcaccactgccactcgaacctgacccgtgcggtattgcctcatggcctgactgagttcgacgtgcatgacgtgctgaatattttccagtgcacgggcctcaatcacgatgacatgtactttatgaaagcctgtccggcgcagaagggcgattacctggagttctttgccgagattgatttgctgtgcgcgttgtcgacctgcccgggtggggatctatcgctgccaatgtgggggcctgatgcgcaggacccgctaacggtttgtcgtccgttgggggtggaaatctacagattggaggatgggttactgagcggctggagccaaccggaacgtgctgcctacaaggggcagcacgggttgcagattgccaaggcggattgggagtaactcaagattcagcgatcctgcgcatccttggcatctgcctgggcattgcgttctgccacgcgtttgcgttgttcgtcggtgagttccactttgttggcgctgtcacgcagcatcatcagcccaccgacgatcgacccgatcgctactaccataatcaaccacgcataccacggcataagggctctccttgaggcagatgaccgtcgaagaattctcctacggtgataactgctttgagttacgggctttctgagtagttcattgtaggcccgttctgcctcgcaggccctatagtcctgtcaacatcgcatccgcgggggcatcggcgcggtcttgtgcggtgagttggaagtagacgaagcccaccagcatgaagcccaggaagatcaacccgatcagcgcattgaaccaagccattgccaccaggcacaccaccgccagtaccaatgcgatacccggcacgatggggtagcccggtgcgcggaaggtgcgttccagcagaggctcggtcttacgcagtttgaacaggctgagcatgctcatgatgtacatgacgatagcgccgaacacggccatggtgatcatggcggcggtcagggtcatgccgcccaggttgatcaggccatcgctgtagatggcggcgatgccgaccacgccgcctgcgatgatggcgcggtggggggtctgaaaacgcgacagtttggccaggaaagatggcaggtagccggcgcgggcgagggcaaagaactgccgcgagtagccgaggatgatgccgtggaagcttgctaccaaaccgaacaggccaatccacaccagcatgtgcagccagccggagctttcgccgactacggttttcatcgcctggggcagtgggtcgttgatgttcgacaaggtgcgccagtcgcccacgccaccggcgaagaacatcacgcccatggccaggatcaccagggtcaggatgccgctgatgtaggcttttggaatcgtgcgcttggggtccttggcttcttcggccgccatggccgcgccttcgatagcgaggaagaaccagatggcgaaggggatcgcagcaaacatcccggcaattgccggcgcgccgaaggtgtcggaaccggcccagccattgagggcgaaattgctgaagctgaacgccggggcgaccacgcccatgaataccagcagttcggcgacggcgagtacgcacaccaccagctcaaaggtagcggcaagttttacaccaaggatattcaggcccatgaacacaatataggcgccaacagccgcgtgtttcgggtccagagccgggaattgcacgttcaaataggcgccaatggctaaggcaatcgccggcggagcgaacacgaattcgatcagggtcgccaacccggcaatcaggccgcctttctcaccaaaggcacgacgactgtaggcaaacggcccaccggcatggggaatggcggtagtcagctcggtgaaactgaagataaagcaggtgtacatcgcggcgaccatcaatgaggtcaccaggaagcccaaggtgccggccacgccccagccatagctccagccgaagtactctccggagatcaccagcccgacggcgataccccatagatgcagggtgcccaaggtgggtttgaggtgtgtggtcatggtggggtgctccctgaaggggttggaatgattcagggtgttgcagtggacatgccacttcccaaagtgctgtcgtaaagcggtgcgagtgtcgttggcaggatggtttggcgtttgaaactgtatggcgatgcaccaggtgagggcggtggtggctgggttggcgttatcgggagcaagccccctcccacattttgatcgcgttgccaacgcgcgcctgcgggacgtcagacccctgtataaagcccgcataaagccactctttacgccatctttacgccccggtcccaccctcgctctcgttcctttacaccactcctgcggacaattgccccacacgcggcactcgccgttaaacggagaaacttccatgagcgttctggacggggtgtcactgctattggccgtggcgctgttcatttatctgctggttgcgctgttacgcgcggatcggaactaggagcagggctatgcacagttatgactattggctgatcatcgccttctttgccgtggtactggtgccggcaccgttcctggggcggttctattacaaggtgatggaaggccagcgtacctggctcagcccagtactggggccggtggaaaacgcctgttatcgcctgtcgggtgtggatgcacagcaggaacaaagctggcagaagtacatgctggccttgctcgcattcaacctcgcgggcttcttgctgttgttctcgatcctgttgttccaaggctccctcccgctcaacccgcaaaaactgccgggccaggaatggaccctggcgttcaacactgccgtcagtttcatgaccaacaccaactggcagaactacagtggtgaggcgtccctgagctacctcagccagatggtcggcctgactgtgcagaacttcgtcagtgcggcgactggcctcgcagtcctggtcgccttatgccgtgggattggtcgcaaatctgcccagacgctgggcaatttctgggtcgacatgacccgcgccaccctctacggcctgttgccgttgtgcctggtgctggcgctgttcctggtatggcagggcgtgccgcaaaccttcgcccattacattgatgccgtgacgatgcagggcgtggaccaagtcatccccctgggcccggcggccagccagattgcgatcaagcaactgggtaccaacggcggcggtttcttcggtgtgaactcggcgcatccgttcgaggacccgacggcctgggccaacctgttcgaagtggcttcgatcattctgatcccggtagcgttggtgtttacctttggccactacgttaaagacctgcgtcagagccgtgccatcctcggttgcatgctggcactgttcctgatcggcggcgcgacgtcgctgtggtccgaataccagcccaatccaaccctgaaccacccagccgtggagcaaaccgcaccgctggaaggcaaggaaacacgctttggcaccaccggtaccgtgctgtggtcggtgaccaccaccgcggcgtccaacggttcggtcaacggcatgcaggacagtctcagccccctgagcgggatggtggcgctggttaacatgatggtcggagaagtgatcttcggcggcgttggtgccggcatgtacggcatgttgctcaacgtgttgatcgccgtgttcctcgccggcctgatgattggccgcaccccggaatacctgggcaagaagctccaggccaaggaagtgcaattgctggtggtgaccctgctggtgatgccggtcggtgtgctggtgctgagttccatcgccgccagcctgccaggcccggcaggtgccatcagtaaccccgggccccacgggttcagccagttgctgtacgcctacacctcggccagtgccaacaacggttcggcgtttgccggcctcggcgccaataccgcgttccataacctgatgcttggcctgggcatgttgatcggccgctttggctacatcctcccggtactggccctggccggcagcctggcgatgaagaaggcagcaccgattggccagaacagcttccccacccatggcccgctgttcgtcactttgttgaccgtgaccatcttgctggtgggcggcctgactttcctgccaacgctggcgcttgggcctatcgctgaacacttgagcatggctgttgctaaatgaagagcctaggggacatgaaaatgaatatgcctgcaaaaaacgcggcaccggtcaaaacccaggagcctgccaaaaccgccatctcggccctctggcgtccggcactggtccaggcgttcgtcaagctcgacccacgccaactgcaacgctcaccggtgatgctggtggtcgaactgaccgccatcctcaccaccgtattgtgctttgtgcccgataccaccgtgccgacctttgttgcagtgcaaatcgcggtgtggctgtggttcaccgtgctgttcgccaacttcgccgaagccctggctgaaggccgtggcaaggcccgcgccgacagcctcaaggccggcagcgaaggcttgagcgctcggcgccaggaggccgatggcagcttcaaggtggtgccggccaccagcctgcgcaaaggcgatgtggtgcgtgtcgccgccggcgaaatgatccccggtgacggcgaggtcgtcgaaggtatcgccgcggtcaacgaagcggcgatcaccggcgaatccgccccggtgatccgcgagtccggcggagaccgctcggccgttactggcaacacacggctggtctcggactggctgctgatccgcatcaccgccaaccccggtgagtccacgctggatcgcatgatcgcgctggtggaaggtgccaagcgccagaaaacccccaacgaagtcgcgctggatatcctgctgatcggcctgaccttgatcttcctgctggtggtggtgaccctgcagccctttgcccacttcgccaatggcagcttgcccttagtgttcctggtcgcactgttggtgacgctgattccgaccaccattggtggcttgctgtcggccatcgggattgccggcatggatcgcctggtgcgcctcaacgtgatcgccaagtccggtcgcgccgtggaagcggcgggggacgtgcacgtattgctgctggacaagaccggcaccattaccttcggtaaccgtcgctgctcggcggtggtcgctgcgcctggcgtcagtggccgggaactagccgaaggcgcgctgctggcgtccctggccgatgacacggcggaaggcaaatccatcgtcgaatacctgtgtgccttgcacccgcaagccgagccgagcctggatgagttgaccgctgtaccgttcagtgctgaaacccgtttgtctggcgttgactaccagggccgagtattccgcaaaggcgccgtggattcgctgctggcgtttatcggtcagcaacgcagcgagcttctaccgccactgtcgcgggagatcgacaagatcgcccaaagcggcggtacgcctttgctggtatgtgccgatggcaagttgctcggtgcaattcatctcaaggacgtggtcaagcccggcatccgcgagcgttttgccgagctgcgcaagttggggattcgcaccgtgatggttaccggcgacaacccgctgaccgccgccgcaatcgccgctgaagccggtgtggacgacgtgctggccgaagccacgccggagaagaaactcgcgcgtattcgtcatgaacagaacgatggccgcctggttgccatgtgcggcgacggcgccaacgacgctccggcgctggcccaggccgacgtcggcatggcgatgaacgatggcactcaggcggcgcgcgaagccgccaacatggtcgacctcgacagcgacccgaccaagctgctggacgtggtgcagatcggtaaggaattgctggtgacccgtggcgcgctgacaactttttccatcgccaacgacgtagccaaatacttcgcgatcctgccggcgctgttcgcctcgatctacccgcaattaggcgtgcttaatatcatgcacttgcagagcccgcagagcgcgatcctgtcggccatcgtgttcaacgcgctgattatcgtggtgctgattcccctggccctgcgcggcgtgcgggtgcaggcggcgagtgcggcggccttgctgcgacgcaacctgctgatctacggcctgggtgggctgttggtgccgttcgtgggtatcaaggctatcgacatgctgctgaccgcgctgcacctggtttgaactcgccccgttggtttgccgaattattgaggatttgacgatgactaagatgatccgcccggccctgagcctgctggtgctcatgagcctgatcactggcgtggcctacccgctggtggtcactggcgtggcgcaagtggccttccccgaccaggccaatggcagcctggtgcgcgatgccagtggcaaagtgcgcggctccagcctgatcgcccaggactttaccggcgacaactggtttcacccacgcccgtcagccggggcttttgcgacggtgtccagcagtgccagtaacctggggccaagcaatccggccttggcgacccgcatcttcgaggatgccagcaagcaatcggtgcctggccagggcccggtgccattggcttcgctgactacctctggcagtggtcttgatccacacttgccaccacaggcgattgcctatcaactggcgcgggtagcggcggcgcggaatgtgccggtggcgacgttgcagcggttgttggatgagcacatcgaaagcccgttggtagggccgccggtgataaacgtcctggccctgaacatggctctggaaaaactctgaaccactgtgggagggggcttgctcccgatagcggtggttcagtcgaaatatctgtcgctgatacaccgctatcgggagcaagccccctcccacagttgatcttcattgacctgaaaatacctgcctgaaggaacccgcatgagcgactccggccgcgccgacgccctgttagccgatctgccccgtaacggccgtggccggctcaaagtcttcctcggcgccgcgcccggcgtgggcaagacctacgccatgctccaggcggcccacacccagttgcgccaaggcgtaagcctgattgccggtgtggtcgaaacccacggccgcgccgagaccgaagccttgctcagcggcctgccgcaacaaccgctgctacgcagcgagtaccgtggcgtaatgcttgaagaaatggacctcgacggcctgctcgccgccaagcccaagctggtgctggtggatgagctggcccacagcaacgcccccggcagccgccatgaaaagcgctggcaagacattcaggaactgctcgccgccggcatcaacgtgttcactacggtcaacgtccagcacctggaaagcctcaatgaccaggtgcgtggcatcactggcgtgcaagtacgtgaaaccctgccggactgggtgctgcaggaggccgacgaactgctgctgatcgacctgccttcccgcgagctgctggagcgcctgcgtgacggcaaggtgtacgtaccggagcaggcgcgtgcggccatcgatgcgttttttacccagaccaacctcatggccctgcgcgagctggccatgcaaaccgccgccgcccatgtcgacgacgacctggcccagggctaccgtcaactgggccaggctgcgccggcagtccgcgggcgtttgctggtcggcgtagatggcgatgcacaagccgaacgcctggtgcgccatgccagccgggtggcccagcgtcggcatttgccctggagcctggtgcatgtcgataacggccgggcgcgggacgagcaatcgcgcctgcgcctgcagaacgcccagcaactggcggagcggctgggtggagaagtggtgctgctgcgtgccggggaagtggccaagacgctgatccagcatgccgctgaacgccgcgccagcttgttgctggtggggcagtcgcgcatgcgctggcggcggcgcttgttcggtggcggtttggcggcgcgcctgttgcgcaatgcccgaggcttggaaatcaacgtcctcgacagcgatgacatgcctgcaccaccgcgcctgccggatgtacgcgggttggtgtggttcgattacgccttggccgtggttgccacgatggtcgctactgccgtggcctgggccgtatccagcctactaccgctgccgaatatctcactggtgtttctcgctgccgtgctgctggtggcggtgcgcagcagcctggggccgtccctggtgtgcgcggcattgtcgttcatgacctacgactttctgtttatcccgccgaatttttccttcgccatccagcgcgaagaggatgtgctgaccctgttgttctttctgctgatggcagccttgaccggtaaccttgcggcacgtcagcggcgccagttgcaggcgttgcgcgatactcaggaggaaaccagcgagctgctcgacctgtcgcgcaagctcaccgctgccaccgatcgccaggcggtgatcagtgccgcggcccatcatctgcaaggttggagcgatctcgacctgtgcctggtcaatcgcgacggccaaggcggctggaagattgagaccggaggcccattgaccctcagcgaagccgagcgcgctgccgccgattgggcctggcagcatgaccagcccgcgggcatgggcaccggcaccttgccgtttgggcgttggtggtggtggccgctgtcgggtgaagaggggccattgggcttgctcggtgtcagtgccaaaccgggcctggagttgagtggccagcgtcggcgcttgctcactgcgttgagccagccgctggcccaggcgctggcgcgtgcacagctggggcaggagttggaatcggcgcgcctgcatggggaaaccgaacaactgcgcagcgctttgcttgcttcggtgtcccatgatttgcgcacgccgttaacctccatgcgcggcagcatcgacagcctgctggccctcggtgaggccattcccctggaggatcgccgcgaattgcttgagggtacccgtgacgaagccgaacgtctggaccgttatatccagaacctgctggacatgacgcgcctgggccacggcgcgctgaaactggcgcgcgattgggtgtcgcccggcgatatcgtcggcagtgcccttgcacgcttgcgcgccgtgctcgcacccttacaggtgagtaccgatatgccgtcggaactgcctttgttgtatgtgcatgcagcgttgatcgaacaggcactggtcaatgtgctggaaaacgccgcacgtttttcgccaccccagggccgcttgcagttgagcgcgggcgtggccgacaaccagctgttttttgccgtggccgatgagggcccgggaattcccgaggatgagcgtgcgaagatcttcgacatgttctacaccgctgcccgcggcgaccggggcgggcagggcaccggcctcggcctggcgatctgccagggcatggtcggcgcgcatggcgggcatatcagcgtggccgatggcattgaagggcggggtacctgcattaccctgtttctgccattgccgacacagcctgccctggaataaaccttgtaggagcgagcttgctcgcgaaggtcgttaacgataatgatggcgtcctgagtttacgcggtgcctatgggtttttcgcgagcaagctcgctcctacagaggggtgattttttaatggattttgacggataccatgagccagaccgcgacgattctagtcattgatgacgaaccgcagatccgcaaattcctgcgtatcagcctggcctcccagggctataaggtgatcgaggccggcaccggcaacgaaggcctggcccaggcggccctgagcaaaccggacttgctggtgctcgacctgggcctgcctgacatggacggccagcaagtgctgcgcgagtttcgcgagtggtcgacggtgccggtgctggtgctgtcggtacgcgccagcgaaggtcagaaggtcgaggcccttgacggtggcgccaatgactatgtgaccaagcccttcggcatccaggagtttctcgctcgtgtgcgtgcgttgttgcgccaggcaccggcgggagaggcccaggaagccgccttgagttttggcccgctgacggtggacctggcctatcgccgcgtactgctggacggtgccgaagtggcgctgacccgcaaggaatacgcggtgctcgcgcaactggcacgtcatcctgggcgagtgattacccaacagcagttgctcaaggacatctgggggcctacccataccgaggacagccactacctgcgtatcgtggtggggcacctgcgccagaaactcgcggatgacccgacccagccacggttcatcgtgactgaggcgggggtggggtatcgactgctgggtacttgagttcaccgctgcctgaacaggcctcatcgggggcttgcccccgatgaggccatcaacaacacccagaatttcaggcctgctcactctcataccgatccagcgtatccctggcaatctcccgccccagggcgatcagttccggcgccttgtagaactcgaaaaaccggcacacccgcttcggcacgttgatcaggatatcgggcggatacccggcgatcttgtattgcgccaatgacgtctgcatcacctcgaaactctggttgatcaggtccagaagcgacgcaggcccgacgttatcgatgatgaacgaacccgtcgccgacttcggtgcgccggctttctccggcgctgcggcgggttgctgggattcgggttcggctgactccagccatgggttgatctccgctgcctgggcctgcaaggcctcctgctcgagcttcatcaactgctcggcctgcttgcggcgaaacggcaggtgcgaacccagcgatttcgccaggctgttgaagcggctcttgaacgcaggcggacgtgggatcaccggtagctggtaatgcttctggttggtggcattgaggttgaccgcgatgatcaagtcgcagtggctcgacaccaccggcacgatgggcagcgggttgagtaggccaccatccaccagcatgcggttgccttgcatcaccggggtgaacaggctggggatcgctgccgatgcgcgcatggcctgatgcaggcagccctcctggaaccagatttcctgctggttggtaaggtcggtggcaacggcggtgtaggggatacgcagttcttcgatattgatctcgccgacgatcttgcggatctgcccgaagactttttcaccgcgaatcgcgcccaggcgaaagctcacatccaccaggcgcagcacgtcgaggtagtccaggctttcgatccagttgcggtactcgtcgagcttgccggcggcgtagatcccacccaccacggcgcccatggagcagccggcgatacaggcgatgtcatagccgcgtcgttcgatttcttcgatcaccccgatatgggcgtagcccctggctcccccggagcccagcactaaggcaacacgttttttcatgaccagatccttcgaaaaacaggtgcccacaatgcacccatcgggggggcggcttcaatcttcggctgggcctgcgatatttttcgaggatagcccttgtgctcgggtatgctctggcaataggtactaccgatttcaggctaaggacaaggcactttttcctgtgggcaacgtctacaggctacgaatgattttgcttattttgaggtgtcatcaatgaaagcctggatgtgtgtgcctgtgatcgtgatggccttggccggttgtgctggcaaaactgcctaccgcgacagctgcggctcgcaattggacgccgcctggaaagaactcgacctggccaaggctgaaggtttcgccggcaccgtaagttattccaaggccctgtcgctgttgaccggcgccaagacccagcaacaattcgaagcgtttgaaggctgctccaacaaagccgaaaaggcgcgtttctatattcgagagtctcgcgccgggcgttgacctgtagcgagtaggattattcatcgcaaagtgagggcaggatgtcagccttggtcaatcagttagtcgctcaggtcattggcctggaagtagggttactgagctgccaggctcgccttgccgccgtcaccgacgatgaagcgctgcatgatttgcgcaccaccgtgcgccgtctgcgcagcctgttgcgtccgttgcgcggcctgccaggtgtcgagcaactcgagttggccgccaagactgtgggtcaactgaccacgccgctacgcgaccgagaggtcctggcggcgtatttgcatcagcacggacatcacgacgcggctgatcggcgcctgcgcctgcaacccgagacctatcgccaagtggcgcagagcgcagaattggcgcatctgttgctgatcctggatgcctttccccgatttatccgcgcagcccagcaccagaaactgctcaagggcctgcgcccgcgcatcgagaagcgcctggccaagcaatggcagaaactcgctgacgcgctgaaggatcccgaacatgatcgtcaccgcctgcggttgctgatcaagcgcgtgcgttacgccgccgaggcttatcccgagttggacaagttgcccgccaacgccatgtcgcggttgaagaaggcccagggtgcactgggtgactggcatgactgctggcaatggctggcccaggccgggcaccagccggacctgcaaccctgtgtggcggtgtggcagcgcaccatgctcaaggcgcaaggtcgcgctgatcgtgtgctggacaaactcagcgccgattgtttttgaagtggtccggtttttggccggaataggcgctgtgcctgccggattcgatggttaagatccctccatcgattttcttgatgtgaggtcgccatgcgctttagtgatttgctcgacgctgcccgtagcaacccgctggatgtcaccatcccggccgaatgggcccagggccgtgccacctttggcggcctggtcgccgccctgcaatatgaggccctgcgcgcgcaggtgccggcggatcgccccctgcgctccctggccatcacctttgtcggtccggtcgcgccggatgtgcccgccagttatcaagtcgaagtgttgcgcgaaggcaaagccgtcagccagttgctcggccgcgtggtgcagaacggcgaagtggcgaccctggtccaggccagctttggcgcgtctcgagcatcggaaattgacgtggcgagcgaagcgccgccggtattcaaacattgggatgagtgtcaggagttgccctacatcaagggcgtcacccctgaattcatgcgccatctggcgatgcgctggagcgtcggcggcctgccgttcaccggtaacaaatcccgcgacatgggcggttgggtgcggttgcgcggggatgtgaaagaagaaccactgaccgaggcgcatatcctcgccctggtcgacgcctggccgccggccctgctgccacacctgaaaaagcctgcgccaggcagcaccctgacctggaccatcgagttcatccagccgctgcaagacctgaccaccctcgattggtgccaataccacgtcaacatcgaacatgcccgcgacggctacggccatgcggccgctgcactatggagcccgaccggcgagttgatcgccctcagtcgccagaccgtggtggtattcgcctgagcctcagtgccggtggcgctgccgccaggcgcgccaccagccaccgctcaatacaaagcgcgggaaggtcacgaactgctcgaccaccagccgttgcaccgcgtctttacggtcactgaacggctcactggcctgggcctccaggctatgaccatgacgctgcaacgccaggcctgccacgatccccaccacaccgacggcgaagctggccagactcaggctgaaaacccccgagacgatcagcagaaagccgacgataaacagcggcacggcaatcagatgcagtgccaggttggccgggtgttgatggttttgtgggtagtgacgccattgccaggcggggagattggggtgacgtttgcccatgatggtgaatcctctgtccgttgaaatgacttgaacagagtttaggttcgggcgggcggggtagcgaatcaaggctggctatgggggttatagagaacaatttgggcggattgatctcatgcccaaatcacacaatcatggtcatccatgtgtactaaaaacgtcagttcgttatcggttatccaaaatggataaccggtggtttcgcctaaaacagatgctaaaactggtgtgttatcaattttccatgccctatatgttgagtctaataccagcagaagtaaactattcttgctgatgcgatacggcatttctttccaaaagttagggttatgctctgtgtatttttcgttcagttcggtggaatcaagcacgttgctttgtgatttgaaaaattttcgcgtcggagaatttatcaatacgttgagttcattcgcatcaagcttccttgagctgattttcaaggtgttacatgcttcgtctatttcctcttccaagtagctcatcaagggataccttttttggagcggctaagaggaaccagtttgagcagtatatggcctctctttgcgcctccaccggacctctttccaggagtttgatagccgatatgaggtgattttgggccttctttgcttggcacaagcagaaggtcgtcaatattcacttccactcccctattgggcccgctttgtacacgccattccgttggaaatgatttgccatattggtctttgccccatttcggtacgctgtattcagtctccggtatgcctgttctacggaaggcctcatccaacccatcgggttgcgaattggggctggctatgggggcatagtgattacgctatttttgttctatctagaaaaaataatcgtctggaccatttatgtatacattcggatcgcaaagtgaaatgaatttagccttgaattcaattagagaactttcattctttgcttggaaatgaaaaaggtcattttgcttagtaatatcaacataaaacacctctctaagggggatgttgtatatttttaattcgcgaataccatgacaatcgatgcccattctgcaggtgttatagcctttcccttcccatttttttggcaagatatctgggaattcgggtatgtcgaaccctaatcccacagaaggtcgatcattttctatttgcaaagaaaaaagagcaatttttccgatttctatagacgtgctaaaaatcttttcaaaaaaatattatgatcaagttcgttccagtatttcatcggtttttcctaaagttgtaatgatccttgccgccgtttacggttccgtttcgaggcttgtctattggtcgcaaattgaaatgcgctttttggtcacctatgccgtctggtctgccaaatttatgccctgcagaatggtcttgaataagtactttagagccatctgccctcgtgaattgataaacccttgaatttatgaatctaccgctctcatccaatatattgtcatcattcaaatcagtcattttttctactaggtactgtgtcgttcttcctgacttcggatgtgtcatcacatcggggttttgagtcatcggtacattggcatccctttttgcttgcctgaacgcccctttacgagagacatcaggtatatccggttcagcaggcaaagagcaggtcggttttttctttcctgagcccggacaatttgtgctcaatcccagcggatcaatccacccggtagggttgggcacgtactggtacgcattgaccccacccgccaacttcaccgggtccggcgtcaggtagcgaccaatatccggattgtagtagcgatggcggttgtagtgcagcccgctttcctgatcgaaatactgcccttgaaagcgcaacggattgtcgatcttgcctacgtcgagccgggcgatctggccgtaggctcgatagtgggcggaccagacgatttcgccttcgggcgtggtgagttcctgcggtgtgccgaggtggtcgagttggtagtggtagggcgttgtgacttgcggtccatagccttccagcagtgccagggggcggaagctgctgggctcgtagatgtagctgcggtgacactctgcatggtgctcggcaatcagcttgtcgccttgccagaaaaactcggtggtcttgccgtccacggtcttgctgatgcgccgcccaaaggggtcatagcggtaactggcggtttcaccgtcgggcttcttcacgctgatcagccggtgctggcagtcgtagcggtattcagtgacgagctgatggcccttgccgcgtcgttcgcggatgaggttgccgaaggcgtcgtagtcgtagtgacggtcaccctggatcaccaggcggttcgccgcgacgatgtccgggccggggcggtcttgcatgagcaggttgcccgccgggttgtgggcaaagcgttcctggacgtcttgcgaatgatcggcgcgggtcaggcgggcgagggggtcatagtggtagcggtgttcgcctttgcgggtgtcgagcaggcgggtgaggttgccggatttgtcgtagtcgtattggcgctggtagcggtggttttggtgttgggtcaccgcgtgagcgtgcaggcggttttggtcttcgtagtggtagtggctgaggagctggccttgttggcgttggtgttcacggccggcacggaagagatgcgatgtgagcacttcgccattgagctcgacggtggcgaggtggccgtctttgtcgtggttgaaggtgaggcggttgttgtcgggcaggcgcagatttttcagctggccgcaggcgtcgtagccgtagcgcaaggtgccccagccttggtgttcggcggtgaggcggttttggcggtcgtactcgtaggccagggcccagtggccgtcttcgacgctgagaaggttgccttggcggtcgtaggcgtaatcgaccacgctgccatcgggcagggtttttcggacgaggcgcccggcgtggtcgcgctcgtagcgggtgaccaacgtagagtcatcgtcaccgtattccgtcttctccagcagattgccgttgaggtcgtaggcataggcggtgcgctggccgtcgaagccggtttcctgttggagcaggccgttggggtgataggtgagctggtaggtttcgccgacttcgttttcgatttcggtcagcagtaagcgagcgttgtcgtagcgatacttgacctgggtgccgtcggcgttgaggcggcgactgatcaggtgcaggccgccttcgtattcgtagcgtgtgacgtggccgagttcatcgcgctcggcgatgatttttccgtaggggttgtagctcaattcccggcaagcgccgccgggctgggtcagtttcagcagacgtcctacggcgtcccattcataaagagtctgcgcgccatgctcatcctcacgcgaaacctgccgccctagatcgtcatagcgataacgcttgatcccgccagtgggcaattgctcctcaagcaactgcccacgttcgttccataccagccgatgacagctgtgatcgggataccaaactccggttaactgcccacgtttgttgtagctgtagtccgtgacctgcccgtcaggatcggtcctgcgcgtaacatcgccctggtcattacgctcatatttccagaccgcctcgccacgcctgactacgcgtacgaaaccgttgtcatgctcgtaggacgttggctcgtcatcccccggaaacagcgccaccaagcgtccggcttcgtcgtactgataggccgtcaccgcgcccagcggatcttgctcgacggtcagccggccttggtcatcgtaggatttgaagtgctgggcgccgtccggatcgatgcgctgcaccaagcgcgcccgatcatcgtggacataaacttcctggctaccatcggcgttatgcaccgtgacacgaccgtcatccccccaggcataacgcgtgtccatctgcgaaaaactcgcccaatgccggacacagcgtgccgccttgccggcgccttcccacgcccaaaagaaactcgccccaccggccaactgccgctcgacaatgacgtgctgatcgtcgtaccgataacgctcgctttccccgacagcattggtcgcgaaaaccagtcgtccatcttcgtcataggcgtaggaaacgacgttctgctcggtctcccagacgtagggcccacggtctttggcgcgatgaacctggtagtccaccgcgacgatgcgatccagctcatagcgcagcaacagtgagcgaccagcgccgttatccaaccgctcaatccgccctgaacgatcacggacaatgcgcaggcggttgtcatacgcatcgctgatcgccgtcagcgcaccgtcgcgaaagtgatagaaccgtgacgcctgagccagcaccagttcatcgggaaccgagcccaggtagatcgccgcttcggccaggctattggtgatcgcgggtcgagaatcggtgggcaacggaaactgcgtacggcgattctcatgatcggtccacaccaccgattcgccagacacaacaagccgatgcgccagcgcatggctccagccaaaccccaacccacaatccagttccaccgcactggtgcgataaacccgcgtccactcaaacggcaagatcccatccagcgtgccatcggtgagggtcagcaattcctccccggtgaccatcgacaccgggcagccatgagtgaccgtcttgtccgcaggcgccgtcgcatcccccttcggattcgacgccatggccggcgcatcatcgacatgttcctgccgtaccagtaccgtctgccgggccttgctgcgtaccgccggcaccggattcgcaaccaactgctcgccagccttcaacggtacagccggcactaccttgaccggcgtcgccgcactgctcagcaacacaggcttggccgcctctacatgagcctccaaccgcggcccggtcgcctgcttggccagcaatttcaacaacgcccgcgcttgcccggacttgacgcgactgagcatttgggcacccaggcgcagctgtaccccaaagccccgcgtggcccagatcagcagcaggttgatcaagacttcgccggtgatttcacccagcagctcatacatctgcggcggcggcagcatgcgtatccacgccaccattgccgccaggtagataaacaacagcggctcatcactgagcaccagcaagcccttggccagcgtgtctttgcccagcgtgagcaactcgtccagttcagcccgggagatgtacttgagcagtttctcgctgttggatctgaggttcgcgagcaggtcatacagctcggtgatgttgtcccacaggttgtagaaggcctggccaatcccggacgcaaaggcaatgccctgtaggccgctgcgtttgtaggctggcgcctgggcaaagtctgcccactgaggcttgaaacgctcgtcccattgtttgcgcagttcagcttccagcccggcaatcactgacccgtaggaggcatacagagccttgacgtgatccttggaaacattggggtaaaaggtgatctggtagcgctggtcgcggctgcagtcgttgacttcaagaatgccgctcgggccaatggtccggtggaacggtgcgcccaccgggctgccatcctcggccagggcttgcagcatcacatgggtgttgccgatgggtacgaactgggtactttcgaacaaatgcaccagggtcaacccaccctgggctttgcattgagcgaccgtgcggctgggcttgtcggaagagatcggcgcgaccagtgcgacgtcttccccaaccttgaacacctgctccacagtcagtgccgagccactcaacaggctggcggcccactcatcgaaggcaggtgcgaaaatcggctaaaacccgactgacgtccggggccttgggatccatgggcgccagcacaaagccagcgatcaccggaatcaagagccagtcctgtcaaccagggctgtaacgaaaaaaaccatctgcaatccctcgcactgtttgatcaggcgagggactttgcaggggttcctaggtaaaagaagtcggcgttattcgcgagaatggcgaggaagtttcgccttaacttcaggtaaaccgagacttggcggtaggaatcagattacaggtgaaaaagccttacagcttcagttgcccaatcgccttgctcaactccccagccaacgtcgccagttcgttgctggtagtcgccgacgccacggtctgctgcacggtgttttcggtcacatcgcgaatgcttaccacggcgcggttcatctcttcggcgacgtggctttgctgttcggcggccacggcaatctgggtgttgctctcgcgcatctgtgccacggcaccggtgatttcagccagtgcggcgccggcttccagggcttgttgcacacagtcgtcggctttgaatgagctttcctgcatgaagtccaccgcgtcgcgggtgccagcctgcagcgccgagaccatgcgggtgatttcgtcggtggaggtttgcacgcgcttggccaggttacgcacttcgtcggcgaccaccgcaaaccctcggcccatgtccccggcgcgggcggcttcgatagcggcgttgagggcgagcaggttggtctgttcggcgatgctgtggatcaccccgaccacgccgttgattttctggctgtcttcggcgagtttctggatcatctcggcggtttgttgcacgccagtggacagcccggcaattgaacgctgtacccgggtgaccacgtcctggccgctgccggcgagggtatcggcggtctgggacaagtcgcgggtggcgccagcgtgctgggcgatatggtggacagtggcggtcatctcattgatggcggtggcggcctggtcggtttcgctctgctggccgagcatgccgtgctgtacctcgttcatgctgctggccaggcgggctgcgccgtcatccagttgccgggcggtgcgtgccacggtattgaccacgcgctggtagccggcttgcatggcgttgaacgcactggccatctggccgacttcatccttgcaggccaacggcacgcgagccgacaggtcaccggttttttcaacgtgcagcattacgtccttgagggtgttgagttggctgagcaggaaacgaatcaacagctgcgaggctccgagcatggccagcatgaggatggccacggcgacggcgtagttggcgaagcgttcactgaacacttggctcaggcttggcgcataagccagtacggcgacgtgttgaccgtcggcgcggctgatcacctcggcgcctatcagcgggtttttgccgaacaacggcatgtgactgagctcaacccaaccgctggcagtggtcagggccgggagatcctgatcggccagttgtggggtttgcccttgtccataggccagccaatgctcgccggtgggcaggactttgtcggctggccacgcgctgagcaatcgcccctgggcctgggccgatgcctgggacgcatggctgcgcgcctgttgttcaagctgcacggcgtacagcaccaacagcagagtggtaacgaaggcgaccgcattgacggcccagaacttgtacttgagcgagatattgctaatccaggcacccatgaaggttttctctgatagcggaaacagcattggcaaggtgccattattgtgccgctacccaggagatgagttttgacgtgggtcaatgggccgcatcactccacggcaggcaagtcgaaaaaggcacgggcgcaagcggtgctatgggctgccagatcttgcatggtttcgttgcggtgcagggcaacctcgcgcaatacctcaggcaagtacgccggttcattgcggccattctttggtttggggcgcagagtgcgtggtagcaggtacggggcgtcgctttccaacatcagacggccgcggggaatttccctgaccagtggatgcaggtgcgtcccacggcgctcatcgcagatccagccggtaatgccaatatgcaggtcgaggtccaggtaactgaacagcgccgcttgttcgccggtgaagcaatgcaccactgcggcgggcaggtggtcgcggtaatctttgaggatctccagcaggcgttggttggcgtcgcgttcgtggagaaataccggcagtttcagctcgctggccagggccaggtgttcttcgaggactttttcctgctgtgggcgaggggagaagtcccggttgaaatccagcccgcattcacccacggcgcgcacccggctttcccctagcaagccacgcaagcgttgggcgctgtcgccattccagtcactggcggagtgagggtggataccggaagtactgaacaggcgctggccgctttcatcgagctttacacacagctccagtgcttgttcgctgccctcgatgctggtgccggtgagcaccaattgctgcacgtcggcggcgtaggcgcgctcgagaacggcctggtgcctctcgtcgaaactggggttggtcaggttgacgccaatatcaatgagttgcatggtgctatctccgcctgcggccggaaagcatatcagagctgtagatttataagaaaaaccaagaactacaacgcgttatcgctgtctttgaacgtcgcaagcgacattgtggttgggctgttgcccgtcactgtgtcgccgttgcgcgctttgccagcgcttgaagcgctctgtttctgacctccagtacttcgttattcgcgaaggcgctggccagtattctttccggagagcggatgatccgaccctcggcgttgcttgtgttgtgcctgacgttgctgctgcccatggcagcggtcgcgcgtctggacgggccgctggaagtgaccaagcccggcaaggtacgtgacctggcgcaaattcgttccagtcgcaccctgcgggtgttggtcaaccagagccgcaacagttccggtgaagtgcagggccagtccatcggtgtcgaataccatcggttacgcgccttcgagcaatacctcagcggccatgcccgcgatgggcaggcaatcaacctcaagatcattcccaaggccaaggaccaattgctcggcgcgttggcccgtggcgaaggcgacttggtggctcccggtgagttgctggatgtgaaggccgtacacaagatcagtaccagcgagccgattgccagtggggtgccgttgtggctggtcggcgtcaagggagagcgacggttcacccgcttggagcagttgtctggtcgtacactgacgctgaccactggcagtgcggcggcggatgccatcagccaggtcaatcagaaactggccctgcacaagcgcccacccgtgaaggtggaatgggtcgatccgagcctggcggtagaggatgtgctggaaatggtccaggccgggatctttcacctgactatcgttgaaaagccgattgccgagcgctggtcgaaaatcctgcccaagttgcgctttgacaagcaggtcgtgatcagcgaaccgggtgacgagttctggttcgtgcgccaggacgcgtcgatgctgcgcgccagcatcgatcgatttctcaagacctatcgaacgccttccgaccaggacgtggcgttccagcgtatctatcgacgcctctatcaggtgcgcaatccgctggcccgcgccgaccgccaacgtctggaaaaactgcgcccggtcctgcaaaaacatgcgcgtgagcaaggcatggactggttgaacctggcggcactggcgtacaaggaatcgtccctggacccgggcgctcgcaacagtggtggcccgaccggcctgatgcagatcacaccttcggcggcgcagcgggtaggggtgaacaatatcgagagtctcgacaacaacgtgcaagccagcgcgcgttacctggcgatgatccgccgcaagtttttctccagccccaagctcaacgagcgcgagcgcatggcctttgtgctggcggcgtacaacatggggccggagcgcgtacagggcatgcgcaccgaggccaagcgtcgcgggctcaaccccaaccagtggttcttccaggttgaacgcattgccatggagcaggtaggaatgggcgccgtcagctatgttaatagcgtcaataagtattatttggcgttcgatcgggagcgagagtcccttgaaccgccagcgccgaaaattgcctcgcgcaaataatcgaatttattgatattgattaggcaatttttcggcttttaacattgcttaaactgattaatatagcggccaaccaaacccctacctggaaaaggatttattacatgagccctatgattacccgtgttctgtccacccgcgccggttacggcctgactattctgcgcattttcgtcggcatcatttttgccgcccacggttcgcaaaagctgttcggctggtttggcggcggtggcctggccggtactgcacagtggatggaaagcatcggtctggcgccgggcaccctgatggcggtgttgtcgggcggtaccgagttcttcgccgggctggcgttgatcatcggcttgcttgcgcgtcctgcggcactgggcttgacgttcctgaccctggtggcgattttctcggtgcacatccataacggtttgttcatggccaacaacggttatgagttcgcgctggccctgctcggcggctcgctggctgtgttgctggaaggcgccggtaagctctcggtcgaccgcgcaatcgctaactgatcgcttcacaagctacggaaaaggcccgcatgtgcgggccttttcgttgcgcaggattcttgacactgccccaccggcttctctaggatgctgctcatgcgccgatttaaacagctaattgcggggcgccactgggactcaatgcagcccgacagaagtatgatccctcacatagggaacacttcgaaataccgctaaagcgctggttcggtgttgcctctcacctgcccgcagacttttgaggcagagacacgacacgatgaatgcactacgccctctcatacgcttggctccgatcaccgcagccctgactcagcgcaacccgaaaatactcctgggtggtaaacaccagccgacgctgctgcgttacctggacggctggccacgtcgtagcggccggccttcggcattcctgattcagtttgtcgaagacggcgactccttggctcgttttgccaataacagcttcgatctggcggtcattcaggcgcccagcgccggcgaagccgacgaggtgattcgtcaattgacgcgcattgcccggcaagggctgatagctcgtcgctgagcgctcagcaggcggccgtcatcgcggctgctcgccgtcgccgttggtatagaaaaagcacccaggcaatcaggcacaacaagagtggcatcggggcgatcatcagccatttcaatgtgtgttcgaatcgatgcagcgacgcataggcctggaccttcagcgcatgcaactcaacgggtaagcgcaggcgttccttgttgagggcctgcaactgggtattggtgtccaccgcctgggtgcccagacttgttgctggtggattcagccgttgccaggcgtgttcggtgtgctcaagtcgtcgttccaactcaccggcgctttgccgataagcctgtgcggcggcttcgcgcataggctccagcctgtgcaggggttgcgtcatgacgcgggctcgaatgcgcctgagcgcttcgggagccgccaggttatccaatgtgttcaatacaaacagcgcgttgttgttggggtgggcattgccgacagtgtccgacagcaggtcggtgtcggctacgaccacgagttggatgtgtttcgccttttgcaagccgggcggctgcccctttaaaccgtcgggaaatgccgaataggcgggcccctcaaggcgagcggcgatcacatggcgctgccccgacgtggaggcttcctcaacgaaggcgtcgaacgccgtcgacgatgcaaaccgccccgcgtccaataatgaggactgtggtgaactttgtagcagcggggtgaagacagtatggctctttgcggcacgggagagtgcgccgctgctcgacacggtcacggagttcaatttccaggtgctgacatcgtctgcggccattgcctgacgtggaagttggagcctcgccgggtgcaataccgtgggcattccagggccaggcttggccgacgaagcatacaggttgtccaccagcagcttgtctgcgggcatctgtatgccccaagcggtgagcagtgcatttaaccggacatttgccgaaccggcgttggccccgatctcgctcacagggtcaataaaaaccatcagtttggtgcccctcaatacagattgttcaatcgcatacagggccttctccggtaaggcatacggctgtaccaccatcaatgtgcctagcgacgccggcacttgagtgagggtcggtgccagctctacaagattgaagtgcttgcgcatttgctccaataagtttccggcaggtgcagccaagggcagccccgacagcaggccgacagtgggacgttcggggtacattaacttatagatcagatggctgatttcatactcgagcaacgactcagtgtcggggttgaacgcttcaatgcgttgtgcgccttggccggcacgtgtgccgataaggccaatgaacccgcgggtgtcgtcgaggccaaacaagctggctttataggcatcttcagaaaacggggcggggttaatgatgtgcaggctgatcttgttattggcggctttttcgaacgccttgagcaggtcttccacacgctggctataacgtttcaattcatggcttttttgagggaccttcgaattgaaataatataagtccatcgggctttcaagtgttgtgagcagttgccttgtcgctggcgataaagtatggattttttgttgtgagaagtcccagcgaatatccggtaacttgggtagccagaccagattgaaggccaggaaaagcaacaatgtgatgatcaatgtcatgccggcacggagagcggaacgcatcagtggctttccttctcagctgtgtttgtaattgagtgtgatggttgtcgcagaaagaaaagcaaggatcatgcttataaaatacaggctgtcatgcagtgtcagcttaccgctgtccattgtgctgaagcggaaaataggatcaagggatatcaaactgtcgacgacccaaagcggtgcctgatgttcaagtgcgtccagtattgaggaaagcccactgacggtcagcagcaagcccagcgtcaataggagaatggcaaggcgttggtgtgcaagtgcacacacgaagcagccgacggaaagataactgcctgccaataaccaactggccagaaattgtgacgttatcgctatgttatcggccatgcccaagtagttgacggcgatcaccaatgggaaattcagtagcaaggcaatgccgcatacgacccaggcagccatgaacttaccgatcacccgttccacggtggtgacgggcaaggtgttcatggtgtcggcaaagctggtgtcgcgttcatctgcccacagttgcgtcgacaaaatgggtatcaacagtagatagagccacgggtgtaactcgaagaaagcctgcaagtcgctactgttacgctccatccaatggttggcatgcagccccagtgcggcacacagcaccaggaaaactgccacactcaggtaggtactgggtgaggaggcataactggcgagttggcgtttgaatacgatgggcagctgtctcaagatgaagcctcctggctcagatgatgaacgacatcgtctagccgacctggctccagattcagtgccgttatgttccagccgcggtgagcaatgagcgcgttgatcgaggggaaaatagagtgtccaggcatggccaggacggtcaccgtacccggtgtatcccgatcctcttctattcccgcaacgccaggaattaccgccatggccagcaggtcgagcggcgaatctgcagccagggttacggcccggaaatgccgggagctacgttgcaattccgatagcgatgcgtcagccatcaggttgccattggcgatgaccagtgcacgggtgcagatgtctgcgagctcgccgtaatggcgagaggcaatgatgacggtcatatcttcggtcagcgactggatcagccccctgaacttgagtcgttgagctgggcatagtccttccgtgggctcgtcaagcaaaagcacgctgggggagtgcaggatggcctgggcaatcgcaactctgcgcttgacgccaagggacagtaggtcgatgggacaattgagcaccggcagcagctccagccgcgcggctgccatgcccacctggctgcgtttttcggcccccctgaagcctcgaatggcagcgatgaaattgagcaggttcttgacggtcatctgagggtggctcaggccgccctgaggttggtagccgatcgcctttcttgcttgaagtgagtgggtctgggtattgaaaccctggatatttatttgcccggaggtcggtttgatcgcaccggcgatcaaactcaagagtgttgtcttgcccgcgccgctcttgccaaatacgcccacacattcctgaacctgggcgctgaatgagaagttactgattatttgtttcctgcccaggtattttgtcaggttgcttatctcgatcatctgtttaccgaataagtttggcagggcgtatgagggggcgccggcggtgtgtaagtgagcttcaaaaaagggtacgtttaatggctgtgcttgggaacgcgatagagtattaataagaagaatcctacgttcgacccgttcatgcactgaaacaattgttttcgtgatgaagacttattaatgctcggatgtttatctgatgtttatataaagttttctttttttatgaggcctgatgaccatgatgcttctacgtacccttgttcttgaacgtaatgatgaagacaagcctgttaacggtgcgctgctgtgtgcgtttgctgtcgctcaaacagaatcaaactttcttgtgtatagcctggatgaagaggccgagcccggccactccagggtctatattgcggagttgcgtaaaaagctcgaacgctattttctggggggggttgattcgaaagaagacctgcaggtagcgatgcaggtcttcaaacagatcctgatgctggcagctgcgacaggcgcgaagaccagcccgattgcagacgccaaggttccctttcatttcatcgatctgaaaggctgtcggttgccgcctgccaggccggaggatcatcactcggtgatcatcaagaaggcattggtcatgaaggtgatcactttgggtatgtcggccccggcgttgcctgcgatcgaaagcaatacggtgatcgtgccgtcgattcgcttttcatcgcaaatggttgccccccctcggaacccgcgctcaccgaaggccgtgtcgcagtctgtggatgaagaacccattgaagcgtcggcgcaagaggaattggcccgggcggaattggcccaagaggagtccgctctggaagagccggcccagtcattggtgaccataccggaggtacaggaagagatcagcatatcgcctgtcccatttgaacaaaacgacacttcgttcgaggcgtacgaagcagagccccccaaaccgcctgcccaactggaacacacctctttgctcgagatggacagcgcgttgagcaatctggccaaggtcgcccaggagctgacgcaaaaaaatgtgcagtcctcgagaaggaagcgatgctcgaacagtggcaggcacgtcttcagcagcagcaaagccaattggatgaaaagagtcgtgcattggagctgcgccatacacagctgcaggaccaagggcttgaggtcagcaagaaggccgaaaaactggcgatgatgatgttgcagctttcgggcatgcgccagcggatgcagggtacgctgcttgagctggaccaggtgctggagggtcaggtgtgagccaatgggcttgccggcctggatactttccagggttcatttatcatctcacccagccagtcggcaccaggtcatgatgtcctggtgtgtcggcaccagtggacactgtttggggatgcaagcgtttgagtaccaagctgattaccaaagaaggtcatgaagcgcttaaaaaagagttggattacctatggcgcgaaaagcgtccggacactactcgcaaagtgacgtgggcggcttccctgggagatcgcagcgaaaacgcggattaccagtacaacaagaaactgctgcgtgagatcgaccggcgggtgcgctacctgcgtaaacgcctggaagatatgcgtgtcgtggagtacatgcccgagcaggagggcaaggtgtttttcggcgcctgggtcgaaatcgaaaacgaccagggcgagaccaagcgctttcgcatcgtcggttatgacgaaatttacgagcggatggattacatctccattgactcacccatggcgcgggccctgttgcgcaaggaagtggacgacgaggcaatcgtacagacacccggcggcgaggtgtgttggtggatcaccaggatcgagtacgtgaagccggcatgaaggctcgcactccgggcagagtacgagccttcatgcctcaaccttcgcgcaataccgtcaacgggctggcattcagggcccgacgtgtcccgaataccccggcagcgccaatcagcattgcaccgatcacgggtagcagtaacaaccacgggtggggatgccacgccaggtcaaaggcgtagcggtacagcacccaggtcactagttccgtccccagggctgccagcaggccgctgacggcacccagcaggccgaactcaatacgccgggccttgaccagcaacttgcgctcggcacccagtgctcgtagcagtgcgccttggcggatgcgttcgtccagggtggcctgcaggccggagaacaataccgccatgcctgccgccagcacaaacagcagcacgtattccactgccagggtcacttgggccaggatactgcgcaactgctccagcagggcctctacctgcaggatggtcacggccgggaaagcccgtgacagatcgacgatctgttggtcatgaccgggaggcaggtagaagctggtcaggtaggtcgcgggtaaattcttcaaggtgcccggttggaagatcatgaagaagttaggctggaagttatcccagttgatggtcctcaagctggtgacccgtgcctcgcgattttccccgccgatggtgaataacagatggtcgttgagcttgagtttcaggctctcggctaccttggcttccaccgacacgccaggaatctcatcgctcggttgcgccgaccaccagacgcctgccgtcagggcgttgcccggcggtaagtcggcagcccaggtcaggctcaggtcgcgctggatggcacggtcgccgctggagtccttgctgacgatctcctgcacaggttcgccgttgatgctgatcaagcgccctggtaccaccggatacagtggcgccgcttgcgcctgtacgtccagcaggcgggcaccaaaggcctccttgtcggcgggcaggatattcagtgcgaagtagttgggagcatccttgggcagctggttttgccaggtgtcgagcagttcgccgcgcaacagtgcgatcaaccccatcgacaacaggatcaggccaaacgccagggactggcctgccgctgccagcgggtgacgcagcaattggcccaggcccaggcgccaaggcaaggaggcgcgggccaataaccgtcgcaggcttttgagcagcaacagcagcaagccgccgaggatcaatgcagccactacgccgccacccagcagggcgaaggtcaataccaggtccaggctcaggcgccacatgatcaggcccagcgcaaacagtgccgcgccgtagaccatccaggtgctcgaggggatcggcagcagatcgcgacgcaatacccgcagcggcggtacgcgacccagtgcggccaaggggggcagggcgaagccggcgagggcgaccagcccggtgccgatccccgcggcggctggcagcaacccacccggtggcacgtcggctggcagcaggtcgtgcaggaaatagaacaggccaaattgcgccagccagccaagcagggcgccgaccaggctcgccagcaggcccagtacgctcagttgcaggctgaaaagcagcatggcttcgcgtcgcgataaccccaggcagcgcaacaacgcactggcatcgaaacgtcgactggcgaaacggttggccgacagcgccacggccacgccggccagcagcaccgctaccaggctggccatgttcaggtagcgctcggccttgccaagggcgccgccgatctgctggttgccgtcacgggagtcctgcaggcgctgattggcagcgaggcccggcttgaccaggtcgcgataggtttgcagtgcggcgctgccttgtggggcgcgccacagttcgcggtagctcacgcggctgcccggctggaccacgccggtggcgtccaggtctgccaggttgatcatcaccctgggcgtgaggctgtagaagttgccggcacggtcgggttcgtaggtcaggatgcgtgccaggcgcagggtcttcatgccgacatcaatactgtcaccgaccttgaggtccagcgccgtcagcagtcttgcttccacccaggcttcgccaggcttggggccgccgccagggctttcagtgccaaagggctcggcgctgcttttcagctccccgcgcaatgggtactgctcgttgaccgccttgatgctggagagctggatgccgttgtccgtggcgataacactggagaactcgacgatgcgggcgtgatccaggcccagttcggtgccagacctgatttgctcggggcgggccggcgagctgccttcgagtaccaggtcggcgccgaggaactcggtggcgcgcagcagcatggcgccgttgaggcgggcgccaaagtagccgatggcagtgctggcagccacggccaccagcagggcaaagaacaacacgcgcagttcgcctgcgcgggcatcgcgcagtaattggcgcatggcaaggctgaacaggcgcaacagcggcaagcgtgccatcaaggctccaggggcgcgaccatcaggccggcttcaaggcggatcaggcgtcggcaacggtgggccaggcgctcgtcatgggtgacgagtaccagggtcgtgccgctctctttattgagttcaaacagcaggtcgctgatgcgctcgccggtatggctgtcgaggttgccggtgggttcgtcggcaaacagcacgtccggctcggcggcgaacgcgcgggcaatggcgacccgttgctgctcgccaccggacagctggcgtggcgagtgggtcaagcgctggcccaggcccacgcgctccagcagatgcctggcacgctcgcgggcgtctttgcgcccgtcgagttccagcggcagcatcacgttttccagcgcgttgaggctgtcgagcaattggaaggattggaatacgaatcccacatgctcggcacggatgcgcgcacgctggtcttcatcgagggcgctcagggcttgcccggccagggtgacttcgccgctgctgggcaggtcgaggccggccagcaggcccagcagggtggatttaccggaaccggagctgccgacgatagccaggctatcgcccttgttcagttccaggctcagttcgtgcaggatagtcagttcaccttccgcgctgggaaccactttgctaaggttccgcgcggtgagaatgcttgcgcccatggagaatccgatgcgaatgtggtttttgagtgctggcctggccttgatgtgcatggcccagaacgcagcggcgggtacagtcctgatcgttggcgatagtatcagtgccggtttcggcctggatacccgcaaagggtgggttgcactgctggagcaacgcctcaagaaagagggtttcgacgataaagtcgtcaatgcgtccatcagcggcgataccagtgcaggaggcctggcgcggctgcccgcggcgcttgcagagcataagcccgacgtggtggttatcgagcttggggggaatgacggcttgcgtgggcaaccgccagcgcaattgaaacaaaatcttgcgtcgatgattgatcagtccaaggccggcggcgccaaggtgctgctgttgggcatgcagttaccacccaattacgggccgcgatacaccaccgcatttgccgaagtctatggtgcgctggccaaggaaaaaaacattccactggtaccgtttttcctcgaaggcgtgggtggccatccggaactgatgcaggctgaccaactgcacccggcagtcgccgcccaggacaagctactggaaaatgtctggccgacactaaaaccgctgctatgacgcttttctaccggcaggctttcggctaaggtggcgcccccctgatctggagccctcgatgtcgcgccctgcctggtccctgtttaactaccaactgatcgagccggacgagcagctggatctgttcgcctgccaggaagtgcgggtgcatctggtggcgcgtcaattggagttgggcggttcgatcgatcgcacgctttgcggcactttactgccggcgcaaccacgctggtcctcggtgaatcgctcgattttccaggaccagcgcctttgccccttgtgccgcgcgatcctcgaatcgcaaaaacgtggtacgccgccgatctggccggagctgcgtttcgagctgtaaaaacagcttgaagcttgctgccacgaagccgtatacaatcattttttacctacccgtcgtcttgcgaaggattttccggatgttgtcgcgcctttccgtcgtcacctgctgcctgtctctcgctgcgctctgtgcggccggttcggcggcagccttgcagttgccgttgccgccgccgggcgaggacattgtcggccaggtccaggtgatcaaggccaagtacgaagacaccttcgccgacctgggcaccacctatgatctgggctattcggaaatggtcgcggccaacccgggcgtcgatgcctggttgccgggggcggggaccgatatcgtgctgccgacacgctttatcctgccgcccggcccacgggaaggcatcgtgatcaacctggcggaataccggctctactactatccgaagggccaggacgtggtctacacctacccattgggcattggccgtgaaggctggggctcgccgatcgcccataccagtatcatcgccaagacgccaaacccgacctggacgccaccggcctcgatcaaggccgagcacgcggccaatggtgacccgttgcccaacgtggtgcctgccggcccggataacccgctgggaccgttcaagttcaccctcggcacgccgggttatctgatccacggctccaacatgaagtttggtattggcacgcgcaccagtcacggttgcttccgcatgttcaataacaatgtattggagatggccggcatggtgccggtgggtacgtcggtgcgcatcatcaacgatgcctacaagttcggcagcagtggcggcaaggtctaccttgaggcccatacaccgttgaacgatgacggcaccccttccgtggtcgacaagcacacggcggtgatcaacgccttgctcaagcgtgaagacctggccaataacctgcgggtgaattgggatcaggtgcgtgacgtggttgcggcggaggatggtttgccgaccgagattggcgtgccgggcgcggcgccagtggccgccgccacgtcggtcgacctgtaggagcgagcttgctcgcgagaaacccataggcgccgcgcttattcaggaagcacgcgttatcgttgatgtttttcgcgagcaagctcgctcctacaggtggcgcgcgccaaatccaaggcaataaaaaagccgatccaaacatggatcggcttgataacaaccccgaaggattattacttgcggcttgctttttcaagcatgcgcagggcgcgctcgttagcttcgtcagcagtctgttgtgctttttgggcagcagccagagcttcatcagctttacggtaggcttcgtctgcacgagcctgggagcgagctgctgcgtcttccgttgcagtcagacgagcttcggtttctttggagacgctgctgcaaccggtagccagaactgcggccagagccagagcagagaatttcagaacgttgttcatcgtgttccccttcaaggactttcaattagatggctactgtctcagggtgagctaatagccggcgtacatactacccattacttgtagtaagtaaactgacgttgcgcaagaagcaaaaaaaattcctgcgccgaatctattttggctaatcttttggaggtctgtataaaaactgtccaattttttctatctcgacaggcattggatccaggctgaaagggccggcccgcatgtgtgaagccttgtaaatagatgaaattttatataacgaagcgggcacttccgttctgtgtggctttactccggctggcatcttttacccatctagaggtgactttaagagcggcagttcgtctcaagattcaactgccggcaatgttcaggctatcggtcaccggttgatcgaggccctttctataaccacccagggcagggaatgatgagtgcgccttgagcaatggcgggattggtgcctactattccctacgtgctggttgtgagcgctcacggttttctcgttgtcgaaaccggcacggggtggcgtagatgttccttcgccggaaaaacatcggtaaggtaggggtcgcaatcttagacccgcgaggagtagtgatgagcgaggcgttgtccatccaccatgaccaggctggtcatcagttcgagaccaatgtggacggtcatcgtgcctatctgacctatatggacctcgggaagcagaccctggatatctatcgcaccttcgtgcccaatgcgctgcgagggcgaggcattgcggccgcgttgaccgaggcagccttgaagtatgccgaagagactggctataccgtgattccctcgtgctcctatgtcgagcgctatatggagcgtcaccagcgccatgccgcgaagctgtagctgattcgttgccaataaaaaacgccgggcttagcccgcgtttttgtgtatgcctgattcaggaaaaatgcgtggttcagctgcgtttgcgcttgggcagtacgtccttgagcttggcgtgcatgctgcgcagggtggtttcggtggcagcccagtcgatgcaggcatcggtgatcgacacgccgtattgcaagtcggccagatcctttggaattgcctggcaaccccagttcaaatggctctcgaccatcaagccgatgatcgactggttgccttcgaggatctggttggcgacgttttccatcaccagcggctgcaacgccggatctttgttggagttggcgtggctgcagtcgaccatgatgttcggcttgatcctggccttgttcagcgcctgctcgcacagggcgacgctgaccgaatcatagttgggcttgccattgccgccacgcaacaccacatgaccataggcattacctttggtggtgacgatggagacgccaccttcctggttgatacccaggaagcggtgagggctggagaccgattgcagggcgttgattgccacggtcaggccgccatcggtgccgttcttgaagcctacggccgaggacagcccagatgccatttcgcggtgggtctgggattcggtggtgcgtgcgccgatggccgaccagctgatcaggtcctgcaggtactgcggcgagatcgggtcgagggcttcggtagcagtgggcaggcccatttcggccaggtccagcagcaatttacgaccgatatgcaagccgtcctggatcttgaacgagtcgtccaggtaggggtcgttgatcaagcctttccagccgacggtggtacgcggcttttcgaagtaaacgcgcatcaccaggtacagggtgtcggacacttccgccgccagcaccttgaggcgttcggcgtattcgtgggcggccttgaggtcgtggatcgagcagggcccgatcacgacgaagaggcggtggtcggtgccgtcgagaatgtcgcggatgacttcgcggcccttggtgacggtctgcagggcagcgtcgctcagggggatttcgcgcttgagctgatcgggtgtgatcagggtctcgttggattcgacgttaaggtcattgatcggtaaatcagccatcgtgttactcgccagggtcacgggtgccggccgccagccatccccgtgcggcgggcacagcatgatttgaatgcaggggggaggaaccttagcgcgttacacgggcccgcgacaatgggcaaagcccggtttaatccagtgctggctgcacaaccgcctcatgggagaactcgccggcgtggcgcgagacccaatcgcgggccatggcttcaagttgctgtggcgtgggctcggcgttttcgtgcaggcggcaatgacgttcgatctggcacacttgctcacccattcgggcaccgaacaaggcgtgttcatcggcaaagcaaatgccgatgcgataaccgtcttcgactttgcggcaccaggctacatagcccggatagcgggcgctggaccccaatgaggggatatgcaggtcgattgccgtgccggggcgccaggcccgcggccaattgcaggcgacgccgccgcggccgatagtgtgcaggcgttggcggggcagggcaggagaggggcgttggatcaactcgacagcgacatcatcagggtgaggtaaaaaacgacccatgtacacggactccgagcgccgtccaattgacggcagtggcagcagtatagtgaaggaactggaattgaccgacctggatattgaccagcaattgctgggattgccaggtatttcgctggtagtgttcaccagtgtcggttgttccagttgccgctgggcacgccagcagttgccgggctggcgcttgccggtggaccgtgtgtgctgggtcgatgccgggcacaacggtggtgcggtcgaacgctaccagatctttcatttgccggcgctgttcctggtgtgcgagggtcagttcctcgggcaattacagacacgtcttacagcatccgacctcgccgaatgcgtaaaccaggcgcttacccgcctaccagaggatttgccatgacagcagttgcatccccgtcgccacgcattggcatcatcggcaccggtgccattggtggttactacggattgatgctggcgcgtgccgggttcgatgtgcatttcctgttgcgcagcgaatatgcagcggtcagtgaacatggcctgcacctcaacagcacggtgcatggtcacctgcatctgcaccctgttcaggcctatgctcgtgccgccgacatgccaccgtgcgactggttgttgatcggtaccaaatccaccggcaacgttgacctggccccgaccatcgcccaggtcgcggcaccggatgccaaggtggtgctgctgcaaaacggcctcgatgtggaggacagcctgcgtgagcacctgccgtcgtcgctgcacctgctgggcggcctgtgctacatcggtgtacaccgctctgcacccggggtggtcgaacatcaggcgctgggccgcgtcaacctgggttatcacagcggtacggccgccaatgatgaggcgcagcaaaaggcaattgtcgaagcaggtgccgggctgttccaccacgccgggatcgagtcgcaggccatggccaatgtgcatcaggcgcgctggcataaactggtgtggaacgtgccgtataacggcctctcggtcttgctgggcacgggtaccacggccatgatggctgacgagtccagccgtgaattgatccaggcgctgatggccgaggtggtgcagggcgcccgtgcctgcggccatgaaattcccgccagctacgcggggcagatgttcgccatgaccgagaccatggacgactatttgcccagcatgtaccacgactatatgcacaagcgcccgttggagttggcggccatctacgcccgccccttggccgctgccagggcggccggttgcgaactgccgcgtatgcaggcgctgtaccaggtcttgagttttatggatcggcacaaccgctgattgggggagacaccatggcaaagggactgggtgacaagctggtactggcgatttcttcgcgggcactgttcgacctgagcgacagccacaaggtgtacctggccgaaggagtggaggcttatcgcaaataccagatcgagcacgaggaagaaaccctagagccgggtgacgctttcccgctggtcaagaaactgctgagcctcaatgccagcctgggccgtgcccgggtcgaggtggtgctggtgtcgcgcaacagtgccgataccggcctgcgggtgttcaactcgatccagcattacggcctggatatttcccgcgctgccttcgtaggagggcgtagtccctacccatacctggccgcctttggttgtcatctgtttctttcgacccatgcagaagacgtgcgcagcgcactcgacgccggctttgcggcggcaacgattctgtcgggtggtgcgcgtcgggcatcgagtgaagaattgcgcattgcattcgacggcgatgcggtgctgttttccgacgagtccgaacgcgtctatcagtccggcgggctggccgcttttcaagccagtgagcgcgagtcggcgcgccagcctttgcacggtggcccattcaagggcttcctggcggcgcttaacttgttgcagcgcgagtttgccgatgacgcctgtccgatccgcacggcgctggtcaccgcccgttcggcaccgtcccatgaacgggtgattcgtacattgcgcgaatgggatatccgcctggacgagtcgctgttcctcggtggcctggaaaaatccgcgttcctggaagccttcgccgccgatgtatttttcgatgatcaggccggtcattgtgagaaggccagggaggtggtcgccaccgggcacgtgccccatggcatcagtaatgagttgaaaatccagaccgagagctagctgctaagctcattcaatcgccgccatcctggcagtccaggaggttctatgattcgttcgatgctgtatgccacggaccttggtctgtatgcaccgtatgtgatgcaacatgcactggcgctggcgcgaacgttcaaggctgacctctacgtgatccacgtggtcgagcccattgggctgttcgccgaatcggtgctacagagctaccttgatgagaaggccctgagtgaatggcagagccgggggttgagcacggtcatggcgacgattgaacaacgggtgctggacagctttcgcgaggagttgggggagggcgagcaggacttgcaattgattcgctcggtcagggtgatccagggggacccctgcgaggtgattctcgaccagatgcgaaaactttccgtcgacttgctgatcgtaggtagtcatagccaggcaaccagggtgaccgtgccccttgggcgcaccgctgcacgggtattgcagctgtccccggtaccggtctacctggtgccgtcgctgcaacatcggcgcagtgaggatagttgatcggtagaaaaggataaaaagttctagatttatccgtctaacctttaatatagttatataccgtcgctgatacccgtggcgtctatctgctttgagggattcatatgaagcttcaacaactgcgctacatctgggaagtggcgcaccacgacctcaacgtttccgctaccgctcaaagcctctacacctcgcaacctggtatcagcaagcagatccgcctgctcgaagacgagctgggcgtagaggtgttcgcccgcagcggcaagcacctgacccgtgtcaccccggctggcgagcgcatcatcactaccgccggcgaaatcctgcgtaaagtcgagagcatcaagcagattgcccaggaattctccaacgagaagaaaggcaccctgtcgatcgccaccacccacacccaggcgcgctatgcactgccgccggtaatccgtgatttcatcaaacaataccctgacgtggccctgcacatgcaccaggggtcaccgatgcagatcgccgagatggccgccgatggcactgtcgatttcgccatcgccaccgaagccctggaactgttcggcgacctggtaatgatgccgtgctaccgctggaaccgctgcgtggtggtgcctcagggtcacccgttggcgaagctgccgaagctgaccctggaagccctggctgagtaccctatcgtgacctacgtgttcggctttaccggccgttccaagctcgatgaagccttcagtcaccgtggccttacgccaaaggtggtgttcactgccgccgatgccgacgtgatcaagacctatgtacgcctgggcctgggtgtgggcatcgtcgccaagatggcggtcgacaccaacctcgacaaagacctggtggtgctggatgccagcgaactgttcgagtccagcgtgaccaagatcggtttccgccgtggcaccttcctgcgcggattcatgtgcgatttcatcgagaaattcgcaccccacctgacccgcgaagtcatggccaaggcgatccagtgccacaacaagcaagagctggaagagctgtttgacggcgtcgagctgccggttcactgatcacgctcgctcctacaggcgttatttggcctcggtaaccgtaaaaagttgccgggcgcctgccaccagaatctgcacctcatccccttcaaacttgcccagcaggcttttgcccaggggcgagcgcggggtgatgacggtcaccggttgcccgaccacatcgactttcaagcctgcggcgtccggcgccaggaacagccattgctggcggccattctcgtcttccaggcccagcagcgtgccaatctctatacctcgctgatcatcgaaagcacgtagctgcaggttctggcacagcgccagcgactgcttgatttcctcgacccgcttggcttgcccggccgccaggtaagacgcctccagccccagggtgtcgtatttgttttcggcgatgttttcttcgtgagtcgcggtttcgtaggcagtctgcgcggcacgttgggcgatatcgaggtcgacggcgagtttttccaggatcaactggaggacggcgtgtttattcatggtcttcaatcgcaaaattgcaggacattggcccgagacttttcattaggggcgttctggtcctgttgcagccagaactggcatttggggttggacaggttgcgcgcattattccgggcctggtccaaggcctgctgctgttcctgcttttgcaggttctgctggtattgctcgaacatgcggttcggcggctccggcacagcggcggccggcttgcccagctgctcaaccgcctgggccacgggtgccaggctttgggggaacaggtagcgagacgccagccaagtggtcagcgcaatggcgataaaccccagccacaggcctgctgcaatggcgaggcagagcttgaacagcgaaaacggacgggcagacatgatggcctcctggcgagcggtaacggcgtgatggcgattgtcgcacagccgctatgcagaaaatcgcgaacaagccttctgcatcggtgcatttatgcggacaatcgagtctttgatcgatggagcccggaatgaaagcccgctgggatattttttgcagcgtcgtcgacaactacggcgacatcggcgtgacctggcgcctggcccggcagttggtagtggaacatggctgtgaagtgcgcttgtgggtcgatgacctgcgggctttcgagcgcatgtgtccgcagattgatgtgcaggtgagccagcagtggcaggaaggtgtcgaagtgcgccactggccggcgcaatggccaggtgcgcaatcagccgatgtggtgattgccgcgttcgcctgccagctgccgccggagtacatggagtgcatggccgagcgtgagcaaccgccgttgtggatgaacctggactatctcagcgctgaagactgggtagtgggctgtcaccgtttaccctcggtgaagttcaagggcgtgcagaagtactttttctttcccggttttcgcccgggcaccggtggcctgttgcgtgaagccgggttattggagcgacgccaggcttttcagctagatgacgtcgcgcagcgacaattcctgcaaaccttagggatagctccggcggtcaatgcacgactgatgtcgctgttcgcttacgagaaccccggattggccggctggttggacgtgcttgcagcagacgggcgcgcgactcacttgctggtgccggaaggccgcatcctgggggatgtgcaacgctggctgggagtgagcagcttgtcggcgggcgacatccaggtgcgtggtgcgctgacggtgcaggtcattgccttcgtacgccaggagcaatacgaccggttgctctggtgttgcgcgttcaacgcggtgcgcggcgaagactccttcgtgcgcgctcagtgggcggggaggccgttgttatggcatatctatcgccaggacgaagacatccacctcgacaagctcgatgccttcctggagctgtacaccgtcgcactgtcgccggccgccaaagcggctgtcatcgcactttggcaagcctggaacaccgagggcgatatggcgcaggcctggaaaatgctcctggaacactggaccgaggtgaacgagcacgctcagaagtggtgtctggaacaaggcttgcaggccgatcttgcgacggcgctggtacagttttatgaaagttggatatgatacgccaccttgatttttgtaaatcccatccaaatttcggatatatgcaatgaaaactggtaaagaactgaaacccggtacagtgatccgtctcgaaaacgacccttggctggttcagaaagctgagttcaccaagtctggtcgtaacagcgcaatcatgaagaccaagctgaagaacctgctgaccggttacaagaccgagatcgtctacagcgccgatgacaaactggacgacgtgatcctcgaccgcaaggaagcgaccctgtcctttatcagcggcgacacctacacgttcatggacaccactgactacaccatgtacgagctgaacgctgaagatatcgaagccgttctgccgttcatcgaagaaggtatggaagacgtctgcgaagctattttcttcgaagagcgcctggtttccgtggagctgccgaccactatcgtgcgtaaggttgcctacactgaaggttccgctcgcggcgacacttcgggcaaggtgatgaagcctgccaagctgagcaatggtaccgaactgcaagtagccgatttcatcgaaatcgacgacctgatcgagatcgacacccgcgaaggtggttcgtacaaaggtcgcgccaagaagtaattctggccccaccgatacgaaaaaaagcccgaccttgagtcgggcttttttgtggccgccggtttatcagaccgttacgtgcaggcgcacatccacattgccacgggtggcgttggaatacgggcagacttggtgggcggcatcgaccaggctctgtgcgtcatcctgggccaagctcggcaggctgacgtgcaggtcgatgtccaggccaaaaccgccggggatctggccgatgccgacatgagcggtgatcgaggcatcgtccgggatcttacgttttgtctggctggcaacgaatttcagcgcgccgataaagcaggcggagtagccggccgcgaacagttgctccgggttggtggcctgaccaccggcaccgcccaattccttgggggtagagagtttgacgtcgaggatgttgtcgctggaaacagcgcgaccatcacggccgccagtggcggtggctactgcggtatagagcgtttgcatggggcgttcctcttgggttgtcgcgctaaatgtttgcgcgctaagtagttggtgaaaccaatgtatagcgctaatgtttagcgcgcaatataaatttataaatgttttcgaggctggcgagaaacaatgtgggaggaggcaagccagttaagcgaacgaaatgctcaaagcggcgaagatcaaatgtgggagggggcttgcccgcgaagacgtcggctcagcaaacattgatgttggctgacccaccgctatcgggggcaagtcgaatcgtcgcaccgcccctcccactttagatcgcgctctgcaggttgccgcgtagcgcgatcaagtcggcctgcagcttgcgcaattgcgcaagctgcatcccgctcgcgcccaggatgcattggggcacatccttggccttgccctgcaagacgcggccggcgtcagtcagctctaccactaccacccgctcatcttcccggctgcgggtgcggctgagcagaccttcggcttccaggcgcttgagcagcggcgtcagtgagccaggatccgtcagcaggcggctgctgatttcgccgacagtcaatccgtcctcttcccacagcaccatcatggccaggtattgcgggtaggtcaggccgagggcttggagcaggggcttgtagaccttggtcatcaacagcgaagtggagtgcagggcgaagcacagctggttatccagcagcagcgattcgcagggggctgggtttttgctcatggtggtgcctcgaaaaagcatgtctgcacttgaatctagcgggcgaatctttaatgcgccaggtaattctgcccggatggtcagactagcccgctttgcaacgccagatcccagggcggcaccgggctgaaacgggatttgaggtattcgagcaataaccggctacgtgcgttgggctgttgttcgaggcgcagcgcgtaaatgccggcggtttccgggctgggcaagccgttttcacaaaacagcggcaacaactcgccacgcaccaggtattcactggccagccaggtcggcaggtgcgcgatgcccagcccggccagtgcgcccgaaagcagcgcctcggcgttattggcgctcatgcggatgcgccgggggcgataggtcgtgcggcgcccgtccagttcaaaacgccaggcgaacatcggcgccaggccatcccaatcgaggccgtcatgctcgttcagttcccgaggatgggtgggtgtgccgcggtttttcaggtaggccgggctggcgcaagcaatgcgcacgatgctcgccaggggtgtagcgatccggcgagtgtcgacgatatgcccggcgcgcagcaccaggtcgaccttgcccaggtgtgcgccttgcatatcgacaaaactgtcgatcaagtgcaggtgcacatccagccctggatacacgttcaagaagtccgcgatcaccggcgccaggtggcggcgaccaaacgctgccggtgcatccagccggatcaagccttccggcgcatggctcagagacaccgcttcggcccgcgccaattgcaattcactgacaatccgccgcgcgcgttcggcaaaggccaggccggcaggtgtaggcaccactgcgtgggtgctgcgctggaacaggcggctacccactgaactttccaggctgtcgattcgacgggcgactgcggagggcgtcagtggatgacgccgtgcggcagcggaaaagctaccggtttccatcacatcgagaaacaggctcagttgatcggtcagagtattagggttcatagacaagcgcttgtgcgggatcggcatagccattgtgcgttgctgtgcgtttccgcgccagggccgactgcgtagcatgtcagccttgggattgcggagtagcgagcggtgttggatttagtgatgtacctgatattgggtgcggctttgggcaccgtgggtgggctgtttggcattggtggcgggctgatagccattccggtgctcggcgtgttgttcggcctggaccagcaaatagcccagggcaccgcgttggttatggtggtacccaatgtaatgcttgccctgtggcgttatcaccagcgtaatcgcatcgagctgcgccacgccttgccgcttggcgtgatgggcttttgttttgcctggctggggtcgatctgggcggtggggctggatgccggggcaatgcgcatcggctttattgttttcctggtggccttgtcggcctataacctattgcgcatgttcacccgcaacgcgccgccaacggcgcagatgcggtactcctggccctggctgggcgtgttgggcgcagcgtccggctccatgggcggattatttggggtagggggcgcggtagtcgccacgccagtgctcaccagcgtgttcggcaccactcaagtggtggcccagggtttgtcgctggccttggcgctgcccagcaccagcgtgaccctggtcacctacgcctggcaccacgaggtggactggatgatcggcctgccgctggctgtggggggcctgctcagtatcagctggggcgtgaaagtggcccatgcattgccggagcggctgttgcgcgggttgttttgtggcttcctggtggtgtgtgcggtgatgctgacgtttaaagtttgaagccttcgacgatgtactcggccaggcattcggtgatcggtgacgtcatctgtggattgcgcagcaagcgcaggttcattgacggcaacggtggaaagccttcgtcgctgcccagcacccgcaggtcgtcggtgaccaggctttccatgctgaccatcgccgccaggccagcactgactaccgcctggatcgccgctccgttggagctgtggtaggccaggcggtactcgcgtccagctgcgtccagtgcggctcgcgcccaatgggtgtacaggcagtcatcgccggaaatcgccaggggcagcgcgtcatgctcatccacgcagaagcacggtgatgctgcccagaccatgcgttcagtgcgcagtaactcgccaatatcattgccaggctcgcggctgatcacggtcagcgccaggtctcgccgctgcatcagtacggaggacgcctcacagtgcatctcaatctgaatcagtgggtaggctttggaaaactgcttcaggatccccggcaggaaacgcatcacatagtcatctggcgtaccgatgcgtacgagccccaccatatggggctcgcgcagggtattgaacacttcgctgtgcagtttcaggatacgccgcgcataccccagcagcacctggccttcgggcgtaagccgtacctgcctaccatcacgctcgaacaacttgcgctgcagtacatcttcctccaggcgcttcatctgcatgctcactgccgattgggtgcggttgaccaactctccggcgcgggtaaaaccaccttgatcggcgatggccacgaaggtgcgtagcacttctgtgtcgatgctcgggtagccagccaattgatcaatctccgagatgtattgcataagaaacattcgttggattgatcatagcgccaggcccacactttcgtcatccccactggagggcgagaagatgaaaggtcaaaaaggttttgtattgttggacaaatggccgtttgccggcctgttccatacgttcgcacgctggcaactgctgcatcaggaacgccagttgctggcgactttgagcgatgatgcgctcaaggacattgggctcaaccgtgccgacgtagcgcaggaaacccatcggcatttctgggaagacccgctgcgcaaataagccaggatgcagtagggtagagggcgagtttccatggagagccccatgcccgccgacctgtcttattcactcaagcaggctcgacgaatggcgctggccgcccagggtttttccgggcgccaggcgcctgcacagataaaagccatgcacctcaatcggcttatcgaccgcctgggtgtcgtgcagatcgactcggtaaacgcactggtgcgttcccattacctgccgttgttttcccgcctgggccattattccccgttgatccttgaacaagcggcctggagcctgggcaggcggcgttcgctgttcgagtattgggggcatgaggcctcgctgctgcccatgacgttgtacccgctgatgcgttggcgcatggagcgggccaggcaggggcaggggatctatgcgcagatggcgcgtttcggccgtgaacagcaggcgactatccagcgcgtgctgcacattgtcgagcagcaaggcgccctgggcgcgggcagtttatcgacccgtgaggagcgcgccgggccctggtgggattggagtgatgaaaagcacgcgctggaatggttgttcgccgccggtttggtcaccgtcgcagggcggcgggggtttgagcgactgtatgatttgccggagcgtgttatccccggcgagattctccaaaccatcatcaccgaggccgacgctcagcgtggcttactgttgcatagcgcaacggcgttgggcgtcgccaccgagaaggacctgcgcgattacttccgcctcgaccccgccgacagccgcaagcgcgtggccgagttggtcgaggatggtcgcctgctggcgtgccaggtgcagggctggaaacaaccggcgtactgcctgccggtgccgaaggtgccacgcaaagtcgcggccagcgccttgctgtcaccgttcgattcgttgatctgggagcgcagtcgtacggagcgtttgttcaatttccgctatcgactggagatctacaccccgcaagacaagcgggtgtacggttactacgtactgccgtttttgcacaatgagcggatcgccgcccgcgttgatctgcgggccgagcgtgcccatgggcgcctggcggtgcatgcggtgcatgaggaggagacgggcctggatgacgcaggcatgtcggcgctggccttgaacctgcgccagatggccaattggctggggctggagcaggttcagctcaattgccagcgccccagtgccgcccggttaagggcggccctggtgtaggagcgagctggctcgcgaaaaactcaagggtgcctcgttaatccgacgtttcgcgtcatcgttaacggccttcgcgagcaagcttgctcctaccttttgacctgcttcaaggtctcggcaatcaggaacgccagctccagcgactgatcggcgttcatccgcgggtcgcaatgggtgtgataacggtccgagaggccgtcttcggtgatcggccgtgcgccgccgatgcattcggtgacgttctgtccggtcatctcgatatgaatcccgcccgcatagctgccttcggcctggtgcacctggaagaactctttcacttcgccgaggatctgcgcaaagtcgcgggtcttgtagccgctgctggccttgatggtgttgccatgcattgggtcggagctccacagcacctgcttgccctcgcgctgcacggcgcgaatcaggttgggcaagtggtcgccgaccttgcctgcgcccatgcgggcgatcaggttgaggcggccagggtcgttgtccgggttcaggatgtcaatcaggcggatcaggtcatccgggttcatgctcggcccgaccttcacgccgatcgggttgttcacgccacgcaggaactcgacatgggcgccgtccagttggcgagtgcggtcgccgatccagagcatatgggccgagcaatcgtagtagtcgttggtcaggctgtcgcggcgcacgaaggcttgttcaaagttgagcagcaatgcttcgtgggcagtgaagaagctggtttcgcgcaattgtggcgagctgtccatgccgcaggcgcgcatgaaggccagggtctcgtcgatgcggtcggccagttggctgtacttctcggccagggcggagttggcgataaagtccaggttccacttgtgcacctggtgcaggtcggcaaaaccgccctgggcaaacgcgcgcagcaggttgagggttgcggtggactggtggtaggactgcagcaggcggtccgggtccggcacgcggcttttttcgtcgaaaccgatgccgttgacgatgtcgccgcggtaggcgggcagggtgatgccgtcaatggtttcatcattggccgaccgtggcttggcgaattggccggccatgcgtccgactttcaccaccgggcaaccggcggcgaaggtcatgacaatggccatctgcagcagcaccttgaaggtgtcgcggattttcgcggcggaaaactcggcaaagctttcggcgcaatcgccgccttgcagcaggaatgcgcgcccctgggtcacctcggaaaactgacggcgcagctcacgggcttctccggcgaacaccaacggcgggtagctggccaggctctgctccacttgcagcaagtgcgcagcgtccgggtactggggttgttgctggatcggcaaggtacgccagctatcggggctccagggttggctcatcgtgaactcgtgtgatgggtggctgttagggcactaatgttagcagcaattagtgcgtgacctgctgcggccgctggccgacaatcgcgcctttgtcgtgcggtaaaccctttaggagtagtgatgaccgaggagcgtgtcgagcgcctgctggccgaagtccatgatgatttcggcatgatccgtgtgcttgaagtggccgattaccggtttctcgagtttggcgacgccattgagcaaagctgcgtgttcactgccgacccgagctggctggagtacgactacacccgcgccatgttgatcggtgcgttgtgccatgagcaacctgagagcgcgttgttccttggcctgggggccggcacgctgacccaggcgtgcctcaagttcctggcactggaagatgtcgaggccattgagctacgtcctgacgtaccgcgcctggcgattgaatatctggggctggacgacgacccgcgcctgtacattcgcatcggtgacgcgctgcagttgctcgacaccgccgagccggccgacctgattttcgtcgacctgtataccgatgtcggcccgggtgtgggccacttggcctggaccttcctggaaaactgccagaagaaactcaaccccggcggctggctggtgatcaatcagtgggccaccgatgatggcaaaccgttgggcgcggcgttgctgcgtgggttgtatcaccggcactattgggagctgcccgtgaaggagggcaatgtgattctgttggtgccttcggagttggatcaggagttgaacctggaggcgctttcggctcgtgccgaagctttggcgccgcggttgggttactcgttgcagccattgatcaaggctattcggccggcaacctagttgcccccgatggcgtcggtattgccaactcaaatgcccttgaacacccccggccgcttctccaccattgcccgcacaccttcccgggcgtcttcgctgttaagcagtttatccaccatcggcggcaacgcggcggcggcggcggcttcgccctccatgcgtgcctggcgggccgacatcaacgtcgcttgcacgccgagcggcgcctggcgggcgattcggttggccagctcgatggcgcggggcagcaggtcctcactggccatcacttcctgcaccaggcccaggcgcaaggcttcatgggcatcgaactcgtcgccagtgagcagccagcgcattgcattgccccagccggcgacctgatgaaaacgcaatgtggcgccgccaaacggaaaaatcccacgttgcacttccatctgcgcaaagcgggtattactcgcgcacagattgatatccgcagcgagcatcaactcgataccgatggtcaggcagtagccctgggcggcgacgatcaccggtttactgaccctggggcctgcaaaaacgccccatgggtcgcaacctcccagcggcggttgccagcctccagccatcacgccgctgacgttggccagatccagaccggcggtgaaatggtcgccgtgggcaaatactacggccacccgtgcttcgttatgccgatcaaattcgccataagccaggctcagctcattgagcaagtccaggtcaaaggcattgcgcttgtcgactcgatccaggcctaaaagcaggacgtggccctgcagttcacggctgacacggctgctgctggcttgattcatcgggtttgccctcgggcggggaaaggtttcagaccaatggaaggtgaaccgtttaagcgtcatcaccaacaggaccgggcttttgaaaaatagaccctggcgccaagatctgcaaaaaccgtgacgcagcgcggtttatcggtgcctggcgataaaaaaagctccctttttcagctatttccggtatagtgcgcgccggcctttaaccgggccgcgtttaggtagcgcaattccccgaagtcagcttcggctgcacgtccgcacagcggactcttccttgacgaatctttttcattcattcgttttcgcaaatccccgccgacaaagcagccagggcgactcttgagtctcaacacggcatgcgcagctttggagcatgggtctttgcggatgcacttagaggcagacccatgacccaggaaaccggcggcttcgccgcttttaatcttaacccgaacattctcgctgccgtcatcgcgactggctacgaagaaccttcggctattcagcagcaatcgatcccgatcatcatggccggccaagacatgattggccaggcgcaaaccggtaccggtaaaaccgccgcgttcgccctgcctatcctgcactgcatcgatcctgccaagcgcgagccgcaagccctgatcctggcgccaacccgtgagttggcgctgcaagtagcaaccgctttcgaaacctacgccaagcaaatgccgggcgttaccgttgtggccgtttacggcggcgcgcctatgggcccacaactgaaagccatccgcaatggcgcacagatcgttgtcgccacccctggccgcctgtgcgaccacctgcgtcgtgacgagaaagtgctgtcgaccgtgaatcacctggttctggacgaagccgacgaaatgttgaagctgggcttcatggatgacctggaagtcatcttcaaggcgctgcctccaacccgtcagaccgtactgttctcggccaccctgccacagtcgatccgtgccattgccgagcgccatctgcgcgatccgcaacacgtgaagatccagaccaagacccagaccgttaccgcgatcgaacaggctcacctgttggttcacgctgaccagaagacctcggctgtattgagcctgctggaagtcgaagacttcgacgccctgatcatgttcgtgcgcaccaagcaagcgaccctggacctggccagtgccctggaagccaaaggctacaaggccgctgcgctgaacggtgacattgcccagaaccagcgtgagcgtgtgatcgactccctcaaggatggccgcctggacatcgttgtggcgaccgacgttgctgcccgtggcctcgacgttccacgtatcacccacgtgttcaacgttgacatgccgtacgatccagagtcctacgttcaccgtatcggccgtaccggccgtgcgggtcgcgaaggtcgtgcactgttgttggtgactccacgtgagcgccgcatgctgcaagtgatcgagcgtgtaaccggtcagaaagttgccgaggtccgcctgccggatgcccaggccgttctcgatgcccgcatcaagaaactgaccaacagcctggcacccctggtggctgacgctgaatcgacccacggcgacctgctggaccgcctgaccgccgatatcggttgcaccccacgtgccctggctgcagccctgctgcgcaaagcaaccaacggtcaggccctgaccctggccgccatcgagaaagagcgcccactggtgccgaacagcgcgccacgcggtgatcgtccagagcgttccggcgaccgtccggaccgtggtgatcgtgagcgtcgcgctccggtgccattggctgaaggccgtgcacgttgccgtaccgcgctgggtgcgcgtgatggtatcgctgccaagaacctgctgggcgctatcctcaatgagggtggcctggcgcgtgaagccatcggtcgcattcaggtgcgtgacagcttctccctggtggagctgccggaagacggcctggaaaaactgctggccaagttgaaagacactcgcgttgccggtaagcagctcaagctgcgtcgctaccgcgaagattgatccgccctttggctgattgatcgcaaataaaaaatccccgactggttcggggattttttttgccttgaattactggtctcagtcagccgaagcgatagatgtccatgcccaatgcccccatcgtgaacccctgatgagccaaaccaaattgcccgcctgccccccgggcaaaatacagcggcaataaatgctcatcgctgggatggctgcgcacggcatggggcgcctggcggcgatagtcatgcagggcggcttcgttatcggtcgcaagtttgtctaccacccagtcgcgaaactctcgtgcccacggtgtgatcgtctccggcccggcgcgccagtccagctcaccgaggttatgggtgatgctgccggaaccgatcaacagcaccccttgctcgcgcaggctgcgaagggcatgcccgacccgggtttgcagggcagggcccatgcggctgggcaacgagacttgcaccaccggaatgtcggccgctggatacatcagcgacagtggtacccaggtgccatggtcgaaggggcgttggttatcgatgtgtgcgtccaggccgtctgcttgcagcagctcgacaatctcgctcgccaattgtgggtcacccggcgcagggtattgcacggcaaacagttcgcgaggaaagccgccaaagtcatgccaggtttcgggcgcggcgccgccactgaccagcagttcctggctttcccagtgcgccgataccaccacgatcgccttcggtcgtggcagctcggccgccagacgctgcaatgcagggccgctggcaccgggttgcagcgccagcatgggtgagccgtgggagatgaacaggctggggagcataggaagcgtcctgaaggttaatatcgagctatctttaatcagaatgtttatctagatctaatataagttttagtgtcttttgatcgatttatcaggagggtgcatggacgcaaaattttggcaggaacgctgggccaccaatcagatcggttttcatcaggtcgaggttaatccctacttgcagcagtattggtcaacgttggccgtggccgggggctcgaaggtcttcgtgccattgtgcggcaaaagcctggacatgatgtggctggcggggcgcgggcatcgtgtgatgggtgtggaggtgtcggagcaggcggtaaaggctttcttcagcgagcaggcgctcacgccgcaggtcgatcaaagaggcgcgttcaaggtgtatcaggcgggcctgatcgaagtgtggtgcggtgatttcttcgcccttgacgctggggacgtggccgactgcaaggcgctgtatgatcgtgcggcactgattgccttgccacagcagatgcggccgcaatacaccgagcatctcgacagcctgctggcccgtggctgtgagggcctgctgatcgctgtcgactacgaccaggcgcaaagggctggcccgcctttttctgtcccggatgaggaagtgcagtcgctgctggggccgcactggaacgttgtcacgctgcaagagctggacattctgagtcagagccgcaaattcatggcggacggcgtcacccgccttgaggagcgcgtttatcggctgaccaagaggtaaatcgcggccacgaaaaaggggcgattcaatcgcccctttttcgtgttgccgggttatcagccccgacgacgcagtgcgtcgatccgctcttccagcggcgggtggctcatgaacaggcgagccatgccctgcttgatgccaccgttgatgccaaaggcggtcaggctgtccggcatgtgcaccggtagcccctgttcggagcgcaagtgttgcagcgctgcgatcatcgccccggtgccggccaggcgggcaccggcttcgtctgcgcggaactcgcgtttgcgcgagaaccacatggtgattgcgctggccaggaagcccagtaccagttcagcgaagatagtcgccacgaagtaggcgatgccacggccttcttcgttcttgaaaattaccttgtcgacaaagttgccgatgatgcgcgcgaagaacatcacgaaggtgttcaccacgccttgaaccagcgccagtgtcaccatgtcgccgttggctacgtggccgatctcgtgggccagtacggctttcacctcgtcatacgagaagcgttcgagcatgccctggctgacggcaacgagcgcgtcgttcttgttccagccagtggcaaaggcattggcttcataggccgggaagatcccgacctcgggcatcttgatacccgcttcgcgggacagctgctcgacggtctgcagcaaccattgctcatgccgggtgcgtggctgggtgatgacctgggtgctggtactcatcttcgccatccatttggagatgaacagcgaaaacagtgagccggcgaaaccaaagaccgcacagaagaccagcagctgattgaggttcaggtcaaccccgttggccgccatgaacccgttgaagccgaaaaggctcagggtgatgctggcaatcagcacgaccgccaggttagtggccaagaacagcaggatgcgcatcatggttgtagggttctcctcatgcttaatatgtcgcgtactgcggggtatataaggtgcggcatggggtgattcaaccgagcgactatttcaaactgtgtcctacagcttgaatgtagtggcttgaagggattttccgacctgtattgtaagccatgacccacactagtttgccttgccgccccgtgattatagggggtacgtctcgggcgggggggaagtgaaataccacaacacgtaagcgacaaagaagtgttgcagataatcgctgtacgacccgaagcgggccgcacagggtcaattcccttactggcgataggacttgaggaagttgccgatgcgaccaatcgccatctccaggtcatccactcgaggcaacgtcaccacgcggaagtgatccggccacggccagttgaacgcggtgccctggaccaccagcagcttttccgacagcagcaggtcgagcacgaacttttcgtcgttgaggatcgggcacactttcgggtcgatccgcggaaacgcatacaacgcgcccatgggcttcacgcagctgacgccgggaatagcgttgagcagctcccaggtgcgattgcgctgctccagcaggcgcccctggggcaggatcaggtcgttgatgctctggtagccaccgagggcggtctggatggcgtgttggctcggtacgttggcgcacaggcgcatgttggccagcatgtctatgccttcgatatagctctgggcgttgtgcttggggccggagatggcgatccaaccggagcggaaacccgccacgcggtaggacttggacaggccattgaaggtcaggcacaacaggtccggggccagggatgcggtgcatatatgcacggcgtcatcgtagaggatcttgtcgtagatctcgtctgagaacaccaccaggttgtgctggcgtgcgagttcgagcatgcccagcagcacttccctggagtacaccgcgccggtggggttgttcgggttgataatcaccagggccttggtgttcggggtgatcttggccttgatgtcggccaggtccggaaaccagtcggcaccctcgtcacacaggtagtgcaccgggtggccgccagccaaggtcacagcggcggtccacagtgggtaatccggtgccggcaccagcacttcgtcgccattgttgagcagcgcctgcatcgacatcacgatcagctcggacacgccattgcccaggtagatgtcctcgataccgacaccttcaacctgcttttgctggtagtactgcatcaccgccttgcgcgcactgaacaggcccttggaatcactgtagccctgggcagtcggcaggttgcgaatcacatcctggaggatttcgtccggcgcttcgaaaccaaacggcgccgggttgccaatgttcagcttgaggatgcgatgaccttcctcttccaggcgcttggcgtgcttgagcaccgggccgcgaatgtcgtagcagacgttggcgagcttgttcgatttgctgacctgcatggcgatgtgatcctgaaaatgaacgatccagacggcgcgggcactaccctggggtgaatcctgcgcggttcgcacccataaatacgtttgaatgccggaggcgcgggtgccagactggcgttttgaagaggcgcaatcatacgtgccgcctgatccatggaaaagacacagatcagggtttttcagttgccgaggtgtaccaatggaaaagctgcagaaaaccgttgatgaatggaaagccatgcttgatcccgaacagtacaacgtgtgccgcctcaagggcaccgagcgaccgttcagcggcaagtacaatgccaccaagaccgatggcgtttaccactgcatctgctgcaacgagccactgttcgattccagcgccaagtttgactccggctgcggctggcccagcttctacgagccgattgctgacagcgcgatgattgagatccgcgacgtcagccacggcatgatccgtaccgaggtcacctgcgccaagtgcgacgcgcacctggggcatgtgttcccggacggcccgccgccaaccgggctgcgctattgcatcaactcggtgtgcctggacctggtgccgcgctaggcttgaagctgtaaacaggcctacacggatcactgtaggagcgaacaagttcgctcctacaacttcttcccctgacttgaggctctgccatgagcgaatccctgctgagcatcccttgcaccactatcaagggcgagcaaaagaccttggccgacttcgccggcaaggccattctggtggtcaacaccgccagcaagtgcggcttcacgccacagtacaagggcctggagcaactctggcagcactataaagatcagggcttggtagtgcttggctttccctgcaatcagtttggcaagcaggaaccgggcaacgaagacgcgatatccgagttctgtgagctgaactacggcgtcagttttccgctgttcaagaagatcgatgtcaatggcagcgatgcccaccctctgtttgtgcaattgaaaaaacaggccccggggctgctgggttccaagcacatcaagtggaacttcaccaaattcctcatcggccgtgatggcaagcaggtcaagcgttttgcgccgacgaccaagccccaggacttgacccaggcgatcgaagccctgctcaagtgagatgcagtgcgcaggcagatcagagacttgagatcgtcggtacccatagctccaacagggcatggagttcttcgcggcgaaacggcttggccaagtagtcgttcatgcccgccgcccggcagcgctcgcgctcttcggacagggcgttggcggtcaaggcgacgatgggtaggtctggccagcgcccgctgcggcgaatctgtcggctggcttcgtagccatccatcaccggcatgttgcagtccatcagcaccatgtcgaagcgctggtcctcaagcatcgtcaaggcttcgcccccatgggcggccacgatgacctcacatcccagcttgctgagcatacccttggccaccagttgattgaccgggttgtcctccaccaacaggatacgtgcccggtgagcaagcggtgcggactccatctgaatcgggtcgaggatcagttctacgtcgctgcgcaggttgcgttgcaggatttggtaaagcgcattgcggctcaatgggcgtgcttgttgctgcagcggtgccagggccgctacctcttcgccaggcatgaagttgccgtaggcagtgatcagcaagatcggggcgcggatcccagggcgcaagcgaaacaggcactccggacaatcggtgatcaacaggtcgggggccagtgcgctcaagtcatcgtcctgggaataacagcgtggcgtcagcccccaggaaggcagcagagtggtgagcaactccgtcaagccgccgccggcgtgggtgatggcaatcacgtcacctgtgagtgggctgtggcgcgtggcaggtagatgcgtgggcagcggcagatcggcgcagaactggctgccaaagcccacctccgagctgatgctcaagcgtccttgcatggcttcgcacaggttacgggtcaacgccagccccaaccctgtgccgccaaattggcgagtgatgccggcaccggcctgggtgaacggctggaagatcttcgcctgggcatcctgggcgatgccgatgccggtgtcacatacttcaatgttgacccggccctccacggcacgcaggcgtacatcgacgcgtccgaagcgggtgaacttcagggcattggacagcaggttactgacgatttgccgcacacgagtcgggtcgccgatgacctgggcgggaaactgtggatcgatcaggcaagtcagctccacgctcggcgccgcgttttgcgacagcaggttggcggtgtcttccaccagcgaacccaggtcgaacgggatatgttccagttccagttggccggcgtcgaatttggacaggtcgaggatatcgttgagtaattcgaccagtactttgcctgaatcatgggcgatggacagttgctgtcgttgttcggcgttcagcgggctgtccagtgacaacgcaatcatccccagcagtccattgagcggtgtgcggatttcatggctcatattggccaggaaggccgcccttgcctgggccatggccagtgcagttgtcttcgccgcttccagttcatcgttggatcggctcaagcgttggttgctggccttgagttcaagggtgcgcgcagaaacaatattttccagctggcccaagtattccgtcaggcggtcctcggcgtgccgccgttgctggatttcggtctccatgttttcgaattgcaggttggcgacattgaccagcacaccgatctcgtcatgttcgtgccccggtgggcaatccaggcgcgcctgtttgcgtgcactcagttctcggatgatgcgcaccagcggctgggtcagcatcacgtagaacaagcccagcagaatcccggtcaggagcaggctgcggacaaatccgttaagcagggtaatctcggcacggtgcaggaaacggctgccgaaggcgtaggtatcgacgtcaaggcgcagcacgccaagtgattcgtccggcatatggccgaggtacagtcggtcctcgaattgacggttggcgctgaacaaaaaatcactgatgggccggtagttgctttccttgcgcggacgatcgacgtcggccaggaccacgccgttattgtcgatcaactgcgcgcgggtgatggcaggggagtgcagcagccccagggccagctcctgggcgagttcggcatcgatgttgtaggcgatgcgggaggcggggttatgactgatttcgatcagtgagcgtatttcacggttgatggatgcgtcttcactggcataatcaatgccgatttggatcaggctgagcaaggttcccaagacgaaaccgaccagcacagtcaatctggcttgtttataagacaagcggtgggcgaacttgatatccatcgagtgttgaaccacttcacgtttcccttcgcccggcaagcatagctgaacatccacaagctctggctcgcccggcatgaatcgttgttttaatgcagcctcatgcggtgtgtcgcagggttgctaatacgccatcttttacaagaacttgccagaggaatagtcatggattctcgattgaatgccttccttgagcgggccgatgcggtactcgcgcgcctggaacccttgttgcccgccctgcgcgaggccatcgactgggatcaatgcctggccgcccgttggcagcgcgaagggcgcagtggctttctgttgccgctgcaagtgagcctggacatgcgcctgtcggacctgatcggcgtcgacaagcaacgtgaacaactggcgcgtaatacccagcagttcctcgatggcttgcccgccaatcatgcgttgttgtgggggtcgcgcggcaccggaaaatcctccatggtacgcgccttgctcgcccagcatgccaaggcgggcttgcgtttgatcgaaatcgagcgagaccacctggccgacctgccacgggtggtcgagcagttggtcaagctaccacagcggtttattttgttttgcgatgatctgtcgttcgaagccggcgaaggcgactatcgtgtgctcaagagcgtgctcgacggttcccttgagcaggcgccggaaaacgtgctgctgtacgccacatccaaccgtcgccacctggtgccggaaaaccagagcgacaatgacaattggaaacgcgtggatggcgagttgcacccgagtgaggcggtagaagacaagattgccttgtcggaccgttttggcttgtggctatcgttctacccattcacccaggagcacttcctggatgtggtggaacattggatcggcgagttggccggcaaggctggcttgcagtggcagcgcgacgaacaactcgatgtgctggcggtgcgttgggctaccggccgcggcaaccgcaatggccgctgtgcctatcagttcgcccgttactgggtgggtcttaaattgctggaacgtcaaccatgatcgatttacaacaggccggtaccggcctagatggctatgccatgctgtgcgcgcagcttgagtcgttgctcgccgatgagcgggactttattgccaacagtgcgcagttttccgcgttcctgttcaatcagttggatgacttgaattgggcaggcttctacctcaatcgcaatgacgaactggtgcttgggccattccagggccagatcgcttgtgtgcgaattcccttcggacgcggggtgtgtggcgcggcggcggcatcacggcaaacccagcgcgtggaggatgtgcatgctttcccggggcatatcgcctgtgacagcgcttccaacagcgaattggtggtgccgttggtcaaggacggtcaactggtcggcgtcctcgacctcgatagcccgttgctgggccgttttacacctcaggaccaagtggggattgaacagctggcagccatcttcctgcggttgaccgattgctgagacaagcgcgctgatgccgtgttctgtaggagcgagagtttgctcgctcctacagcgttcaggcgcttacagactgtccaggtcatccagttgaatttgcaggaccctctccagttccagcatgagtttttccagggccttgataccggtttcgatcgcggcccaatgctcattgcgcgagcaggcttgttccagtgcttcgcattgcccggccagcgaagtggcttgaacgatacgggcagctcccttgattttgtgggcctgctcaatgatgtccgtcagcgaggctttaccgctcagcaggtccatgagtgcctggcggtcttgacggctgctgctcaacagctcttccagcaagcgtcgactcaattgcggatcgccgccggtcagggcctccaggcaccccaggtccagtcgtgtgcttgccggttgaggggcgatctgcgccaactgccgctccagcacggtcaggctgatgggtttgaacaggcagtcatccatgccggcctgcacgcaccgtagcctttcctccggctgggcattggcggtaaaacccagcaccacacaggcaggtaattgttcccgttgctcgtattcgcggattgaacggctcagctcgtagccattcatgataggcatgttgcagtcggcgatcaccaggtcgaaacgttcctggcgccaggcctggaatccggctgcgccgtgctcggcggcggtgaattgatggcccaggtagcccagttgctggcacatcagcaggcggttcgccgggtgatcgtcgaccaccagcacgttcagcacgggtgtgcgggccggcgtctcaggcgtgtgctctcccagcgcctggaccgggctcaggcgcggcatcctgaggttgacgtgcacttgggtgcctaccaggggcacgctactgaggcttaattgaccgcccatcatttcgcacaggctgcggcagatgaccaatcccaaccccgcaccgctcctggccaggtgcccagagttgtcggcttgggcaaagggttcgaacaggcgcaactggtcttccctgttgatgccgatgccggtgtcctccacgacgagcttcaactcgatctgctccggcgcctgggtaggctgtatctctactttgattttcacctgcccgtgttcggtgaacttgatcgcgttgctcacgaggttcgagagcacttgcttgaagcgcagggggtctatcagcacctcgatgtcattgaggtcgggcttgaactccagcaacaggctcagggttttctgacgcgcaaggccgtcgaagacgcgcacgaccgactcgatcacctctcgcaggttgacgcgctccggggccaggctgagacgaccggactcaatacgcgcgatatcgaggatatcgccgatcaattccagcaggtccttggccgagttgtatgccacttcaatcgccgggcgatcaaggtgcccttggtcggcgcgcttgagcgtcagttcgagcatgccgatcaccgcattcatcggcgtgcggatctcatggctcatggtggcaaggaacgtacttttggcgcgattggcctcgtcggcgcgctccttggcggcacgtagctcatcgaataactggcgccggtcactgatgtcgatccagccaccgatgatgccctgaacctcgccggtggagtcccggtagggcaggatccagtggtagatggtcagtttcttcttatggatatgcaggctgcggtccaggatcagtgggttcccctcggccaccacgcgctgatagtccgcgtggtattgcgccgcctccgactccagggccatgctcatctgggtcacgcttttgccgatcacgtcttcgcgcttcacaccgaatacctgcagatagctgtcgttgcaggtctgcagcaggccattgcggtcgcgcacgtagatcgggtgtggcgtctcattgaccagtgcgcgcatgaattcgaactgatcattgagggcgcgctcggccattttgcggtgcttgatctggcggcgcatgtaggcgttccaggtcaaggagatcaacagcaggagcccggtgccgatgatgatccgcgctatcagttggtggtagttgcgccagtagctgtcggacgcggcggtgtagccacgccagcggctgttgatcacgcccatttcatccggggcgatgctgagcagcgccttgtcgaggattgaactcaattccgtggcttggcgcgatgtggccaaggtgaatgtggcgggggtcgtgccgatgctggcgctgatttgcagcctgtcctggaaaacctgggaagacaggaagtagttggcgatgaccagagtgttcacggcaccgtccacttgcccctgggcgagcaattccgccgcccggaacgtatcgctggtttccaccaggtgaatctgtgggaagtccgtgctcaagctcgcggccaggggattgccttgggttatcgccaggcgcttgccggccatttgctccatattcgagggcgcgccgggctctttgcgcgtcagcagtacgtaggaattttcaaggtaagggcgactgaaattgagctgcgagtctctttcgttgctcgggacgatagcgccgatcatatcgactttctggctggtgacttgctcgatcattgcattgacgtcacgtccgcgctcgatcgagaaacgcaggccggttcgcaggcgtatcagctccaggaggtcggcggtaatcccgcgaaaattgccgtccgcgtcaaagaaggtgagtggcgcgaaggtttcgttcacgatcaccttcaccacaggatgctctttgagccagcgttcttcacgctgggtcagttgcagtttcttatcggtcagcaggatatcgctgccggcgctccagcgtttggcgatgctatcccgttcgttgacgggcacggctgccaggactgagtcgacaatgctcaggaggatccgattgtcttggcgcgtagcaaagctgaaaccataagcttcatgcttgccgaagttggccatgcggatatttttgagataacccttgttgatcatgtaatgggtggaaatggtgtcgccaagaaacacatccgcctggtcgaacgccactgcattcaaggcattctgataagacggataggcgcggatgaccgcattggggtacagcttctctacttcgttgaggggcaggtaatggtagacaaggctcaagcgtagcccttccaggccgtcgttcagactgcgggtttctccctcgcgggtgaccagtacaggctggtccacggcgtagggttcagacaggatgagattgggggttgcggcttcaaagccattggaggagcccaataaatctatctccccggcctccaaagctcgaatggcatccttgcgtgacgggtagcgcatgaccttgatgggcaaggagagcgccttggccagcaacccagcgtaatcagcggtgaggccttcgtaatcatgaccgctggacgtgagatcgaaaggcgggtagtcaggtgcggaggtacccagcaccagttcacgtttgttctgcagccactggcgctgagccttgtcaaaatgagtgtctagttgaatggctccggcacggctcaagagggtgaagtgttccgggctggtttggtgctctgcgagcacagtggtgctgaagcacaaaccggcactcaatataatcagatagtcctttatacgcctgggcatccgctttctcacactagcgcgtttcgttttgccatctcgatgagttctaccaaggatttggccttgagtttctgcattaacctctttttataagtgctcacagttttattgctcagaaacatacccttggctatttccttgttggtacgaccttgtgcaaacagttgcagcaccatcagttcgcggtcgttgactgttttgaagagttccagctcctgggcgtccatgccttcggtgccgggactattcagcgcctggctggggaagtagttatagcccgacagcaccgcgcgaatagcgctgagcaactcgctcagatccccctccttgcacacgtacccctcggcgcccgaacgcatgcatcgcgtggcaaagagcgtagggcactgggccgtcagtaccagcgtcttcatcgatgtgttcatcgcgttgaagcggcagaggacttcaaggccatcaagcttcggaatgctgatgtcgagaatcaccaggtccggaaggcattcacgcaccatctgtatggcatcgcatccgttatctgtttcgccaacgaccttgtaaccctcgtgttccagcaacattcgaatggcgagtcgtataaccgggtggtcatcgataataaaaacagagttcataatcacattccatgcaggtgcaaataaagcgggcacattagctcagaaggtgagggggcagcatgaagccttagggcggtagaagcaaaacaggaaagttcctacgctagaaaaggcatgcacctacaagttgctaggtgtgatggaggtgtatgtaagcattttggacatgatggcgtcatgtaatggcgccttggtatttgcgattagcctcacgtcggttttctctagtggaaatgtttaatttcctacattcgataagtgaaagtcgaggcaatcaagtgttcaagttgatctttgttcaatggttttgataagtagccaagaagcgggagatttcgttgcaaggcttgcatcttcagattaatcagttccgccgggggtaacccgctcaacagaatcgcactggttataaagcgctggcggctggcgatttctaccagttcaagcccgggcaagtcaggtaggcattggtcacatagcatcagatcgaaggggtgttcggactggctcatcaagcgtatggcctgctcggcattttccacgggcgtcagttggtcgaaaccgaagcttttgagcaggcattgggtggccaggagctgaaaggggtgatcctccaccaaaagaatacgaagagggtatctgggcatagagaacacacagtgagtcaagcgtcgatgggggaggagttgctcggctggtccgttaagagcgtgcgtgattattcttcgggtgtatgtacgaattcgatcaggccgctctgttcccatcgtagggcgattctcttcagggaacaggatgcgtggtcgagttgttattgagggctggagcgcccggtcatttcccgcgccatttctgtggcgtagctgtcggtcatgccggcgatgaagtcgatcatccgcaggaacgaagcatgtaatggccaggccgggtccggtgcgctattgcccagtaaatcgagaatgcgcctgttcttgaacgacggggtacgcccgccatgttgttccagggccgcaccgcagaaggcgttcagcaggatttccagggtggtgtaggcgccgatttcatgcagcgtctttcgtttatcctggaagattttcttgcgcgccatgtccttggcatcgagtacgcagcgttttgccgggccgtgcatgtgctcgaccaggtcgcccggcagtgtgccggcgagcagggcgtcctgctgttcgacaaacgcccttgctgccgcgttggtcaggtgttcgatggccttgccacgcaggatcgccagtttgcggcgccgcgagtccagcgggcccaactggcgataggtttgtggcaggtcatcgccgaccaggtccagcagtagcgactcgacctcggcgtactgcagcagctccatttccaggccgtcttccaggtcaatcagcgcgtagcagatgtcgtcggcggcctccatcaggtaaacgagggggtgacgggcccaacgttgctcttccagttggggcaggccgagcttgtgggcgatctgctcaagaatcggcagctcgctctggtaacagccgaacttgtgtttcttgtagcccagtgagtcggcgtggcgggcagtccaggggtatttgagataagtccccaaggtggcataggtcagccgcgtgccgccgtcgaactgatggtattcaagctgggtcagtacccgaaagccctgggcattgccttcgaagttgaggaagtcattgcgttcggcgctggtcatgtcatccagccagccgcgcccggcggcctgctggaaccagtggcgaatggcgtcttcaccggagtgtccgaacggcgggttgccgatgtcatgggccaggcaggccgattgcaccaccatgcccaggtcgctcgggtcgcaccagtcgggcagggcgctgcgcagggtttcgcccacgcgcatgccgagggaacgcccgacgcaactgacttccagcgagtgggtcagacgcgtgtggatatggtcattgctcgataccgggtgcacttgtgtcttgcgccccaggcgccggaatgcaccggagaagataatgcgatcgtggtccttgtgaaaggggctgcgtcccagttcttccgggctgtgcagcggctttccaaggcgttcgcgggtcagcagggtgggccaatccaaggcgggtactctccgtacggtgaatgacaggtccagcttcccggttcggcctcgctggggcaagcgaatccaacggtcgccagtgtcgatatcaattaacaggcagcgcaaaaaaccgcaatgaccaggacatatcgggtcattacggtctttgactcacgcaggtcagtttttgcgcgaagcgccttgcatagccagtttgatcagcgggatcaacccggcacctaaccgtaccagtcgcgtcacgctgctgatactgccacctttggcgcccttgccggtaaagaagcccatcagcgtcaccgccgctacgccccacagtggcgcgtgcttgatgcccaggctgtcctgccaattgtggcgcatattgcgcattttttgcaggggcgccatcagttgctgggactcatggcggatttcctggcggtgcatttccatgcgcaggcggatcagggccttgcgcatttcccggcgggaggtgttttgcgggatctcagtcatgctcatggcagcaggcgctcccggtcattggccagctcttcaagcgtggcgtggaagggcgtggactcatcgaacaccgccgctttcaagcgcaccccgcagaacgcggcggccaggctgtagaacacgcagagacagatgatcccggtcagtcggtagccggtgtcccataccaggatcatcaccagcgtcgacagccccaccagcaacagcagggcaaacaccagcgccagcccggcaaacagcaacaggctgacggtgcgggccttttgctcctgcaattcgatgccgaacaattccacatggctgtgcagcaagcccagcacagcagcgcccaggcgtcgggaggtggaactggttcctgaagagtgtgcgctcgttgatgagctggattcgccgatagacatgatagttagcgccttgtagccagcagaccgatcaaaaagcccacgccggcagcgataccgaccgactgccatgggttggcttgtacgtagtcttcagtggcagtgatcgccgcctgactgcgctcacgcagcgagtcttcggtcaactgcagggtctcgcgagccttgagcaggctctcgtggatcttggtgcgcagctcatcggcctggtcaccggccagcacagcggtgtcgtccagcaacctttcggtgtcacttaccagggtttgaaaatccgccatcagtatctcttgagcagtctttgctgttttaccggccatggttgtctccgtgtgtggctgatctgtacgtgtggtttcgagtcgcggggttcgccgaaggttcagtgcaattgtgtggtacagcttttgctttgccttggtgcgcaggcccttgggcctgcgctgaatccgggcggtcgtggcgcaagccttgaaaaaccttaccctaaatcactcaaacccgcggaaaaccctgtcggcaacggcctgtgtgttgatcgctgcgctaaagcggttcacgccctcttatcaagggtggggttaccggtgccaatttagtgcgcaaaaccctggcttgaaccgctttggtgctttttgccttgatgcaggcctgccaacctccatggaaaatttgcaaagtgcggtggacacccttgtccatagctccaacaccctgttcatcctgattggtgcggtcatggtcctggccatgcacgccggttttgccttcctggaagtcggcacggtgcgccagaagaaccaagtcaacgccttgtcgaaaattctcagtgacttcgcgatctcaaccctggcctatttctttataggctattggatctcctatggcgtgaacttcatgcaaccagcagccgtgatcagtgccgatcatggctacggcctggtgaagtttttcttcctgctgacctttgccgcggcgattccggccatcatttctggcggtattgccgagcgggcaaagtttgctcctcagctgtgcgccaccgcgctgatcgtggcgttcatctacccctttttcgaaggcatggtgtggaacggcaacttcggcctgcaagcctggctgctcgcaacctttggtgctggcttccacgactttgccggttccgtggtggtacacgccatgggcggttggctggcgctggcagccgtgttgctgctgggcccgcgcaacgggcgttatcgagaagggcgcctggtggcgtttgcgccgtcgagcatcccattcctggcgttggggtcgtggatcctgatcgtgggttggtttggctttaacgtgatgagtgcgcaaaccctggatggggtcagtggcctggtggcggttaattcgttgatggccatggtcggcggcacagttgctgcgctggtgatcgggcgtaacgacccgggcttcctgcacaacggcccattggccgggctggtggcgatctgcgccggttccgacctgatgcacccggtgggcgcgctggtcacgggggccattgccggagggttgtttgtgtggtgttttatcgctgcccaggatcgttggaagatcgacgacgtgctgggtgtatggcccttgcatggcttatgtggggtgtggggcggtatcgcctgcggcatcttcgggcagaccgccctgggtgggctgggcggcgtgagcctgatcagccagttgatcggcaccggccttggcgtggtggtggcctttggcggcggcttgctggtgtacggtgcgatcaagcgcatgcacggcctgcgcctgagccaggaagaagagtattacggtgccgacctgtcgatccacaagattggcgcagtcagtcaggattgattggcgcctcttcgtccgtgcggggctgcggatcgaatccgtgcaacaggcgatagtggttgtgccgcacttcatcgacccgtgcctgtacctgttggtccggcaggcccagcaggatcagcgcgtgggaggcgagcatcaggcttgattccagcagctcaggcaccacctcactggcaccggcggccttgagctcagccaactggctgtcatcgcgagtgcgcaccaggatcggcacctcagggttgatccgccgcgcttccttgagcaccagcagggcgacatcgctgttgtccacggcgatcaccaccaaccgcgcccgctccaggccgacggcactgagcaaggcgccacggcggcagtcgccgtaatgcacgctgctgtcctcggtggcggcttcgtgtacgcgtgcggggtcgtcatccagggcgataaacgcctggtgttcgcggcgcaaaaaacgccctatggattggcccacccgcccataaccacaaatcaccacatgcccgtgcagttgcgcattgagcgcggtgatctgctccagttgcacctgctggttgggcttgcggtgcaggcgcagggcaatggccggcgcggcgcgcaacagcaatggcgtcaacagcatcgaacagaacgtggcggccagtagcagcccgttgaattgatctggaatcagccggctctgttgcatctgcgccatcaacgcaaaacagaactcgccaccttgggccagggccaggccgctgcgccaggcggtctcagtgtcgctgccgcgcagcttgaccagtgtggcgactacgcaacctttgaccagcatcagcgtgagggtcaggccgaggatcaacaggctatggctgatgaacagctgcaagtcgatcaacatgccgatgctgacaaaaaacagccccagcagaatgtctcggaacggtcggatatccgcttcgatctggtgacgataatgactttcacccagcaacatgccggccaggaacgccccaagggcaggggacaggccgagcagatgggtgagccaggccgtgagcaacacaatcaccagcgccagcaatacaaacaactccgccgaatgggacgccgcgacttcacgaaacaaccgcggcagcaaccagcggctggcgaataacaggcccacgaacaacaccacagtcttgcccagggtcagtggcagcgcccagtaccaggcttggtcgctgctgccggcgaacactggcaccagcgtcagcagcaataccgccaccacgtcctggaacagcagcacgccaatcgcattctggccatggctgctgaagatctcaccgaggctggtcaattccttgctgacgatggccgtggacgacaacgccaaccctgcacccagcaacagcgcgatgcccggcgccaggccgaagcccatcagtaggccacccagcagcgccccgcagcccagcacctgcaaactgcccaggccaaacaccacgcggcgcagagcaaacattttcgacagggaaaactccaggcccagggaaaacagcaggaacaccacgcccatctcggccaggtccggcaggtcctcgttatcgttcacccagtccagagcagtcggacccaccgccaggcccacgcacaggtagcccagcacgggcggcagttgcagccggcgaaacagcgcaatcaccaccagggatgaggccagaatgatcagcaggttggcaaacacaagcatctccgttgcaggtgagcgggcaaaaaagccgcgagaatcgctgaatcagttataggccatggtgacctgggtcaggtgttttgtcggcaatgggatttcatggggcgagcgggtttagaatgatcacttgtttttctgaccgggttctttcgtcatgcctcctgaatgccagctgttcggcaccctgggttgccacctttgtgaacttgcggaagaggtcctcatgccgttggtcgaccacggtctgatggttgaattgatcgatatcgccgatccagaagacctgaccgaagcctacggcctaaggatcccggtactgcgacgggtcgacaccggggcggaactggactggccattcgacagtgatcaggtcgtcgccttcctgcgctgatatttatgcgatggcgagtttccaaatattacgttactgtatattcgtacagcgattgaatagagggaacgcccgtggtgaatgttgaacaactgaagagcagcgtcaatcgcatgtccgccgacgtcgtgcgcgacgcggtaaacgagctgcgcctcgatggcctggtcacggaaggcaagacgccgtttaacaaggtgcatttcaacacctgctttgcggaaatcgaggcgctgttccagcgtgccggttatcacaagcagctggatgtggtgggttaccagggcttgctttacgcactgtatgatccaggccgttgggaagcggtggacgtattgcgctggctcaaggagtttaccgaggccgcgagcgcgtcgccggtcctgcgggcgcaattggccaaggcctgagataggccctaggcaatcgtgcgccatgcgggataatgcccgcctgtttcccaggcttcgagcatctgcatgtccacttccggtttttccccttcccagcaccaagccagtacgttgtatctgcccccaggcccatgggcgacggtgctcgattgcctgtgcgagcacttcccggccatcggccgcgaacaatggctggaccggattgcgcggggcagggttctggatatcaatggcagcccgatcaggttggacctggcctacaaggaaggcctgtgcatctattactttcgcgaagtgcccaacgagaaagtgatcccggtacaggaaagcatcctgtacgccgatgaacacctggtggtggcggacaaaccgcatttcctgccggttacgcctgctggcgagtacgttgagcagacgctgctgcgtcgcctgatccggcgcctggacaaccccgcgctggtgcccctgcaccgtatcgaccggcatacggcggggctggtgctgttctcggccaacccgcaaagccgctcggcgtatcagcaactgtttcccacgcggcgtatcgataaaatctacgaagccatcgccccagccttgccgaacctcagctttccgttggtgcataaaagccggctggtggatggcgaaccattctttcgcatgcaggaggggccgggcgccagcaacactgagacagccgttgaagtaagagagaaaaacgctggtttatggcgctacggcctgttcccggtgaccggcaagaagcaccagctgcgcgtgcacatgaccgcgctcggcgcgagcatctgcaatgacccgttctaccccgaggtgatcaaggatgctgaggatgactacgccaaccccctgaaactgctggcccaaggcgtgcggtttatcgacccggtgagcggtgaagaacgcagtttccgcagccggatcaccctcgactggtaacccccagaaacaacaaggcccgcgcgaggcgggccttgtgtgcaagcgtcgaggcttacaggtctttaacggtgcgaacctgatctttgttgatgcgggtgcgcttgccgtcaagctgttggaattcgtagaagcccgaatcttcgtcaaatttcggggtgtcgacggcctggatttcgcgaccgtcattcagggtgatcactgttggcgaagcgcaaccggcgagggtggcgaggcccagtgcaagcatgagagcggcgatggtccgttgagtcatgagtttgtctccgagagaatacttttaaaatgctgaccttgtgacgtatgggacgtcggcaaagttccttgtgcaaggctcattctgacacgccagcccgtgggtgcaacagctcgggtgtattaagattggccaggcgcgggtcatcgggcgggcattgcagggccacgccacccagttccagcaagatcttgcgcgggctgcgctcacccgcttgccaggcctgttccacttggtttttcaggccggtcgggatgatgcacagcaagggttcccagaactcgccctggcgtaccatcaccggcaactgtcggttgcgttgggcggtctcacgcaagtcggcgagcagtcgcccatcgatctgcggcacatcgcacggcaggatcagcagatgctcatggcgtgccgcgagcagtccggcgcggataccggcaagcgggccggggaagtccgggttgtcatcgctcaccaattgatcggcatagggcgcgtagcgttcatggttacgattgcacgagatgatcaggtcatcggtgagcggccgggccagccgttgcaggtgggcaatcaagggttcgccctgccattgcagcagccctttgtcctggccgcccatgcgttggccgcgaccaccggccaacagcaggatcgaacagggcaggggtgaagattcaagagacatggtggttccgctgcggcacgtaaatgggggcctgtgatataacatcgggctgttccttcgacaaccggaccgtgccatgaaagccaaggccgatgcgcccttcgtacccctgaatattgcagtattgaccgtcagcgacacccgcaccctggataccgacacctccggccaggtgttcgttgaccgcctgactgccgccggccaccacctggccgagcgcgtactgctcaaggacgacctctacaagatccgcgcccaggttgcccactggatcgcagaagacgttgtgcaagtcgtgctgatcaccggcggcaccggcttcactggccgtgacagcacccctgaagccgtgagctgcctgctcgacaagcaggtcgatggctttggcgagctgtttcgccagatatccgtggccgatatcggcacttccactgtgcaatcccgtgccctcgctggtctggctaatggcaccctggtgtgctgcttgccgggctccaccaacgccgtgcgcaccggttgggacggcatcctcgccgagcaactggataaccgtcaccgcccgtgcaacttcgtcccgcatctgaaacaggctgaaccctgtgaatcccgtgggtaagccgggcaagaccggcgcactgatgccggtggaagaagccttgcagcgtttgctggccatggcccaagccgcgccgatcagcgagcagcaagcgctgcccctggctgagtgcgatggccgggtgctggcccaggacctgatctccacacttgacctgccgccctggcccaacagcgccatggacggctacgccgtgcgcctggcggattggaccggcgaaccgctggtagtgagccaacgcattttcgccggcaatgcgcccgagcccttggcgcccggcacctgcgcccgtatctttaccggcgcgccggtgcctcagggcgcggactgcgtgcaaatgcaggaaaacgccgtggtgcatgccgaccagcgcgtcagttttaccgagcagatgcaagcgggcgacaacatccgcccccagggccaggaaaccacggtcggtgaatgcgtgctcaccgccggtacccgactgggtcccatcgagctgggcctggccgcgtccctcgggcgtgatcgtctcgacgtggtgcgccgcgtgcgtgtagccgtactgtcgaccggcgatgagctgatcgagccggggttgccgctgggccccgggcagatctacaacagcaaccgccgcgtcctgtgcagttggctgacacgcatgggctgtgaagtgatcgatgccgggatcctgccggatgacctggaacagacccgcaggcgcctggcgggcctgggcggcgtcgacctgatcctgtccaccggcggtgtgtcggtaggcgaagcagacttcctcggtattgccctgcgtgaagacggcgagctggcactgtggaagctggcgatcaagccaggcaagccgctgaccttcgggcatttccgtggcgtgccggttatcggcctgccaggcaacccggcctcgaccctggtgacctttgcgctgctggcgcgcccctatctgctacgccgccaaggtgtgacgcaggtagagccgctgcgtttcgaggtgccggcagggttcaactggcccaagcctggcaatcgccgcgaatacctgcgggggcgtatcgagcagggcaaggcggtcatctaccacaaccagagttccggcgtgctgcgcagcgcggcgtgggcggaggggtttgtggaggtgatggaaggcacgacgctggatatcggtgaccaagtcaatttcatccccctgagcgaagtcctgaactgaccacagatcaaaaaatgtgggaggggcccgatagcggtgtatcagccccagatatgtaggctgtaataacgctatcgggagcaagccccctcccacagtagatcttggtacgcctgcggctactcagtaatcgtcgccacgctcagtgacatcccgctccaccggccccgcatccgggtcgtaccctgccgggaacttgcctttgagcgtccatgcaaacgcaatgatctcggcaatcgtgcggtacagctcttctggaatgctatctcccagttccatgcgcgccagcagcttcaccagctcggcgttttcatagatgggtacttcgttttcccgggccagcttgaggatggcttcggccagggcgtcatcgcccttggcggacagggtgggggcttgttggccgtcgtacttgagggcaatggcctggcggggcgggacggcgttcttcatgcggtttcatccacccagcgttgttccagcccggttttggggccgcgtggcggggtgcccaggtggcaatccaggtcgccgacgtcaagccccgacgacaccaggcgttcgcgcaggctgcccaagtggctttcgatcaggctggccgtgaatgggcggctggcccacaactggctggacagtttgccctgggtcaattgcgcctggacttgcagcggccccagcggctccatgtcgaaggccagttcgacgcgccagagcatctgtttcggctcctttttgtccttgcgctcgggttgatccttgtccggcgccggctcctcgcgctgaaacttgacctgcaacggtacgatgtcctgcagggtgcgcatggggatttccagctgccaggtggtttgcaggcgaccatcggcggtggtgccggtctgttccaggctcgacagctgatggctctgcaagcgggagatcgcgccggcggcaaggcgcagcaggttctccaggtcgccttcaccttcgagtttggccatgagccgctccggcagcgggaagcttgccggtatctgccgggcaccgacctggccgagggtgttcaacgggctgcggacaaaatttggcagcacctgggccagggtattggcggcgaggatggcattcaggttggtgctggcgggcagggtgggcagcaggtccgcgaccagccgcaacagcgcgcctttcatatccagcggcgggatctgcgggttctgcccggcgagcagcctggcttccaggaaagcaccgctgttctggatcacctgcgccagtaccttggggttgctgacctgcgccaggtctggcagtgccgccaacaaacgctcggcagcggcccgcaggtcggcggaggtgctgtcgccacggggcaggttttgcaaggcgctgaatacggcatccagcgagccttggcgactctgctgggtagcaagctgttgcgccacggccagttggtccttcaagccgctcaatggcacgaagctcagggtttgcgcgttctgcaccgcggcgctgagcaagctgccaacccgcaggggctgagggctttccagcgtcagggtggcgccggccagggcgttattgagcacgctcaccagcgagcgatagatcgccggctgccccgtgccctggggcagcatctgcgtggtcagcaccttggcttgcagcagcgtgcccaccggcatttgcgaggtatcgaggcgggtgagggcggcgacgttggcgctcatggtctgctgcaaggtgatggccaggttgcccgcaggcgcctggctcaccgccacattgctgcccaatggcaagggctgggcgctgctggcctgtaccagggtctggcgaccgccttcgagggtcaatttgagcaacaactggaaggcttcgctgccctgtttcagcgcgatgacctcggcgttcacagttttccctgggccgatcaggccggcctgcggctccagcagctttagcagctcacccgccgcaggcagcggggcaggtttgggcgctggggctggaggcagtggaggtaggttgatctcgccggtcatcgtgcacgtcgtctctggggaaattgccctctttagagtagggcatcgcatgtataatgccgcccgtctgcaaagagagcggtaaaaacctcacaactatttgatccagctctctaaaatcggtcgccaaagccgttattgtgcatttctctataacggccgctgcaccgccgacttgaaccgtaaaggcccgcgatctcttgaccagccctcttcttgaagccgtagcgcttgcctgtgaacgcgatctgcgcctgttgttcgagcaactcgagctgcggctggcgggcggcgacatggtgcaaatcagcgggcccaatggcagcggcaagactagcctactgcggctgatggccggtttgatgcagcccacggcaggtgaaatccgactcaacggcaagcctttacacgaacaacgtaccgaactggcgcgcaacctcatctggatcggccacgccgccggtatcaaggacgtgctcaccgctgaagaaaacctcagttggctcagcgccctgcatcaccccgcttcccgcgacgcgatttggcaggccctggcctcagtgggcctcaagggtttcgaagacgttccctgccacaccctctctgccggccagcagcgccgcgtggccctggcgcgtttgtacctgcccggtccgccgctgtggatcctcgacgaacccttcaccgccctcgacaaacagggcgtggcccaactcgaagagcacctggcccagcactgcgagaaacgcggcctggtggtactgaccacccaccacaccctgacgcgcctgcccgcggggtttcgcgagctggacctcgggcggtggtcggcatgagtgtgtttgccctgttggtcgcgcgtgaagcgcggctgttgtgccgtcgcccggccgagctggcaaatccgctggtgttctttgcgattgtgatcgcgctgtttccgctggcggtcggcccggagactaaactgttgcaaaccttgtccccagggctggtgtgggtagcggcgcttttatcggttctgctctcgctggacgggctgtttcgcagtgatttcgaagacggttccctggagcagtgggtcctttcgtcgcaccccctgccacttctggtactggccaaggtactggcacactgggctttttccggcctggcgctggtgctgctctcacccttgctggcgatgatgctagggttgcccagcgagtgcctgccggtgttgcttctatcgttgttgctcggcacgccgaccctgagcctgttgggagccgtaggggcggcgctgaccgtaggcttgaagcgcggcggcctgttgctggccctgctgattctgcctttgtacatcccggtattgatcctcggcagcggcgctttgcaagccgcgctgatgggcatgccggcgaccggttacctcttatggctcggtagcctgaccgccctggcggtaaccctgacaccctttgctatagccgccggcctgaaaatcagcgtcggcgaataatgaggtctgacccggcgttgatgacgttgagtcagtaaagaccctgagcttctcgccacgacgaaaagcacccgtgatggaaactgcaatgaactggacctggtttcacaagctcggctcgcccaaatggttttatggcatcagtggcaagttgctgccgtggttgagcgtcgccgccgtgttgctgatcggcatcggcctggtctggggcctggccttcgcgccgcccgactaccagcaaggcaacagctttcgcatcatctatatccatgttcctgccgcgatgctggcccagtcctgctacgtgatgctggcggtatgcggcatcgtcggcctggtctggaagatgaagctggccgacgtggccctgcaatgcgccgcgccgattggcgcgtggatgaccgccgtggcgctggtcacgggtgcaatctggggcaagcccacctggggttcatggtgggtgtgggacgcacgcctgacctcgatgctgatcctgctgttcctgtacttcggcctgattgccctgggcaatgccatcagcaaccgcgacagcgccgccaaggcctgcgcggtgctggcaattgtcggcgtgatcaacatcccgatcatcaagtactcggtggagtggtggaacaccctgcaccagggcgccaccttcaccctcaccgaaaaaccggcgatgcccgtggaaatgtgggcgccactgctgctgatggtgctggggttctactgcttcttcggtgccgtactgttgctgcgcatgcgccttgaagtgctcaaacgtgaagcccgcaccagttgggtaaaagccgaagtgcaaaccagcctgggagtgcgtggatgagttttgcttctttcagtgattttctcgccatgggccaccatggcctgtatgtctggacggcctatggcatttgcctggcggtgctggccctaaacgtcgccgcgccgatcctggcccgcaagcgttacctgcaacaagaggcgcgacgtctgcgccgggagaccgaaaagtgaatccgctgcgtagaaagcgtctgttgatcatccttgccatcctggccggtgtgggtattgccgtgggcctggcgatgagcgccctgcgggagaacatcaacctgttctacaccccgacccagatcgccaatggcgaagccccgctggacacgcgcatccgcgccggcggtatggtggagcagggttcgttgaagcgctccggcgactccctggatgtgaccttcgtggtcaccgatttcaataaggccgtgaccatcacttatcgcggcatcctccccgacctgttccgcgaaggccagggcatcgtcgccctgggcaaactcaatgccgatggcgtggtggtggctgacgaagtactggccaagcacgatgagaagtacatgccgcccgaggtcaccaaggccttgaaagacagcggccaatccgcgcctggcgcgaatccgcagcctgccaaggagggctaagtgatgacgtccgcactgtttattccggagctgggccagttggcgatgatcctcgccctgtgctttgccgtggtccaggccgtggtgccattgcttggcgcctggcgcggtgaccgcctgtggatgagcctggcgcagccggccgcctggggccagtttgccttcctgttgttcgccttcggttgcctgacctatgccttcatgaccgacgacttttccgtcgcctatgtcgcaaacaactccaacagcgccttgccctggtattacaagttcagcgccgtgtggggcgcccacgaaggttcgttgctgctgtgggcgttgatcctcggtggctggaccttcgccgtgtcggtgttttcacgccaactgccgcaagtcatgctggcgcgggtgctggcggtgatgggcatgatcagcattggctttttgctgttcttgatcatgacctccaacccgttcagccgcatgctgccgcagatcccggcggacgggcatgacctcaacccgctgttgcaggacatcggcctgatcgtgcatccgccgatgctctacatgggctacgtcggtttctccgtggcctttgccttcgccatcgccgccttgctcggcgggcgcctggatgcggcgtgggcgcgttggtcgcgaccatggaccatcgttgcctgggccttcctcggtatcggtatcaccttgggctcatggtgggcctactacgaactcggctggggcggctggtggttctgggacccggtggaaaacgcctcgttcatgccctggctggtgggcactgcgctgattcattccctggcggtcaccgaaaagcgcggcgtgttcaagagctggaccgtgttgcttgccatcgccgcgttttccctcagcctgctcggcaccttcctcgtgcgttcgggcgtgctgacctcggtgcatgcgtttgcctctgaccccgagcgcggtgtgttcatcctgatcttcctgctgtttgtggtcggcggctcgctgaccctgttcgccctgcgtgcaccggtggtcaagagccaggtcggcttcaacctgtggtcgcgggaaaccctgctgctgggcaataacctggtgctggtggtggccgcgtcgatgatcctgctcggtaccctgtacccgctggtgctggatgccctcagcggcgccaaactgtccgtgggcccgccgtacttcaatgccttgttcatcccgctgatgggcttgttgatggtggtgatggcggtgggcgtgctggtgcgctggaaagacactccggtgaaatggctggtgggcatgctcgctccggtgctgctcggcagcgttgcgctggccgtggtcgccggtattgcctacggcgacttcaactgggcagtgctcgccaccttcctgctcgccgcctgggtattactggccggtgtgcgtgacatcgtcgacaagacccgtcacaaaggtttgctcaaaggtctgccgaccctgacccgcagctactggggcatgcagatcgcccacatcggcatcgcggtgtgcgccctcggcgtggtgctgtccagccagaacagcgccgagcgcgacctgcgcctggcgccgggcgaatccatggacttggccggttaccacttcatcttcgaaggcgccaggcacttcgaagggccgaactttacctcagacaaaggcacggtgcgcgtggtgcgcaatggcaaggaaatcgccgtgctgcacccggaaaaacgcctgtacaccgtgcagagttcgatgatgaccgaagcgggcattgacgccggtttcacccgtgacctgtatgtggccctcggagaacccctgggcgacggcgcctgggccgtgcgggtgcatgtcaaacccttcgtgcgctggatctggttcggcggtctgctcaccggttttggcggtttgctcgcggcgctggaccggcgttatcgggtcaaggtcaagagccgggtgcgtgaagcactgggtatgggagctgcggtatgaagcgttggttgatggtggtgccactggcgttgttcctgctggtggcggtgttcctgtatcgcggtttgtacctggacccggccgagctgccttcggcgatgatcggcaagccgttcccggcgttcagcctgtcgacggtgcagggcgacaagatcctgacccaggcagacttgcagggcaaaccggcgctggtcaatgtgtgggcgacctggtgcatttcctgccgcgtcgagcatccggtgctgaacaagctggccgagaagggcgtggtgatctacggcatcaactacaaggacgacaacgcagccgcgttgaaatggttggccgagtttcacaatccgtaccagctggatatccgcgatgaagacggcaacctcggtttgaaccttggcgtgtacggcgcaccggaaaccttcttcatcgacgccaagggcgtgatccgcgacaagtacgtcggcgtgatcgacgaggtggtgtggcgcgagcaactggccgccaagtaccaggccctggtcgatgaggctaagccatgaagcgtctgttagccgccgctttcttggccttgggcctggccggtgtggcccacgctgccatcgacacctacgaatttgccaacgacgccgagcgcgagcgtttccgcgacctgaccaaggaactgcgctgccccaagtgccagaaccaggacatcgccgactccaacgcacccattgccaccgacctgcgcagagagatcttccgcatgctgggggagggcaaggacgaccagcagatcatcgatttcatggtcgaccgctacggtgatttcgtgcgctacaaaccggccctcaccggcaagaccgcgctgctctggttcggccctgccggcctgctgctggccggcgtcgtggtgatggcggtgatcgtgcgtcgccgccgcgccgcgccgaccgatggttccgatgcgctttcccctgaagagcgcaaacgtctcgaccaattgctggacaccaagactgatgattgatttctggctcgcagccggcttgctgcttctgattgccctgagttttctgctcatcccggtactgcgcggccgccgtgcccagcgtgaggaggatcgcaccgcgctgaacgtggcgctgtatcaggagcgcgttgccgagctgcaagtgcagcaggacgaaggtgtattgaacgccgcgcaactggacaccggccgcgccgaagccgcccgtgagctgctggccgataccgaaggcgtggaaaagccccgtgaatcgcgcttgggtaaacccttgccgtttttggcggcgtttctggtgcccgtactcggcgttgtgctgtacctgcattatggggcgagcgacaaggtcgaactgacccgtgagttctcccagccgccggtatccatggccgacatgacccagcgcctggaacgtgccgcggcagcccagccggactcggccgagggcctatacttcctgggccgcgcctacatggcccaggaccgttccgccgatgccgccaaagtcttcgagcgtaccgtggcattggccgggcgccagcctgaattgctcggccagtgggcccaggcgcaatactttgccgacaacaaacagtggtcgcccaaggtgcaggcgctgaccgacgaggcgttgaagctcgaccccaaggaagtcaccagccttggcctgttgggtatcgccgcctttgaaggccagcgttaccaggaggcgatcgactactggaaccgcctgctggcgcaactgccggcgcaagacaattcccgtgtggcgctgcaaggcggtatcgatcgcgctgccgagaagctcaaggaaagcggcggtacggtcgcgcacaaggcagtcatgacagtgcgtgtggacctgtccgccgaggcgaaagccaaaaccttgccgaccgacagcgtgttcatcttcgcccgcgccgtctccggcccaccggcaccgttggcggccaggcgcgtcaccgtcgccgaactgcccatcaccgttgaactgggcgatgccgatgcaatgatgccgcagttgaaactgtccaacttccccgaagtccaactggttgcgcgcatatcccgggcaggtgttccgaccactggcgaatggatcggccgcacccaacccctggccagcagcaccactgcgccgcagcagctgaccatcgacagtccggacaagtaaatcgaggaaacgcccatgaccgcatttgcacgcatcaccctgcttagcctggtacttggcttgagcgcttgtgcggtccaccgcccaccgccgtcccccaccggcccgaccatcccgccgtcgggaccgtcgacccagccgagcaccaagccgtctggcccggtgaccccgccgccgaagccattgccaaccaaatcgcccaccttcgctccacccccaggcgccgccagccactgggacggcaagatgcaggtctacgtgctcgacgaccagcccgacaccttctaccgccagcgcacttattatcgttggagcaacggctggagccgctccatcagccccaacgggccctgggaagaaaccaacgtacaaggcgtaccgccgggcttgagcaagcagtacgcacaatgacaaaaggcgaccctcgggtcgcctttttcatggccttgaaatgcactctggcaatcaccgccgggcaaatgtgggaggggccctgctcccgtagcgttaggtcagtcaatgattagctgaatacaccgcgaacgggagcaagccccctcccacagtagatctgtgcgccatcaagcagccgggcggcgaagtcgggattggtggggccatcctgaaagcgcaggggattacatcgtcgtgggctgaaaaacggtctgccagccccgattgcagtggttcagtcactgatggggtgggtcaaacagggcgagctgtgcgcaggcggtcgaccagggatggaaacctggttggggcacggcctcctgcgcacagctcgttcggcataatggagatcttgcggatggttggccgtaggtaaagtcctttattgcgcgtggcgcatacgtggtgcgcggtgagtcgcactcgggtaaggtggccgccgccggtctggtcgtcgcgcgattgctggatatactttccagtgactactccccgaccaacctgatgcaagccaggagccgcgaagggttgtcggtggtacaacaagtctggataagccaagagggtgttttgatggcaggcaggttgatctatctcatcgggccatcgggttcgggcaaggacagcctgctggatgctgcgcgcccgcacttggtcgagcgcggctgccacatggtgcgccgggtgatcacgcgctcggcggaggcagtgggcgaagcggcgcaaggggtgagcccggagcagtttgcggcgatggatgcccagggcgcgtttgccttgagctggcaggccaatggcttgtcctatggaattcctcgtgagatcgacgactggctggcagcgggggacgatgtgctggtcaatggctcccgcgcccacctggcgcagacccgcaagcgttatccgacgttgctggtgctgctgctgacggtggatcaggccgtgttgctccagcgcttgatcgcacggggacgagagtccccggcggacatcgaagaacgcctggcgcgcaacgcgcggttcaccgccgcgctgatcaccggtaatggcgcgggcttgtttgtactggataactcgggcccattggaacataccgtcgcccgtctgctgtgctgcctggaccacgggcactcggtatgcgcctgaccctgctcggcaacggcgatgcatggcaagttcgggcgtacggttgcgaatgcgcggcatgcgggttggcttcgtctgaataggaggggctggcggtacggggtcgtgacctcggagctcaccgtattcattggtaatcgccaagtgcggtaaaaagtcattcgtgttcgattttccgtttgttggggaatgctgttgtgtgagtgtttatccgtgttgcgtcattctgaaattttcaagattatatgttgcaaggttttataattgtgcacgttttgtgaggtttttagttgtgggtaaatgtatttttgtggtgtcgtgaaatcggtctaacgtacatgaagtgacgttttaagttgaaatagatgaagtgttgtctggtgtttttgattgtgggaatttaacgccgcgttgatcgcgtgctcgtatatttttacagcgaattttgccctcggcagactacattgattttaattatttcaacttggataggcggatttgaaaatgcaggttaatgtttccagtgtggggtctcgaagtgatggcttttccagtgtcccaagacaatttaatgctctgagcagaacgggtgaaacgaataagtccaacatggatagtggtcgtcacactgcctctattccattccctcgtaatacccctgcattcagtctgttctacagcccgttggagagtgaggactatcatgtcgataggcatccctctagaagtactaataagagtgttttcaacggctttcaaagtcaaagtagcgtagtaaacgggctgacggaaagtcttaacggattcaggcaggtaatgagtcgctgtgggggatctatcaaccccaatccgtgtccaccttcgaggccgtggcctgaaccctgtccagaaccgcagcccagacctcgcccgtgtccaccgccaaggccagaaccctgtccgcgcccgcagccgccgcggcccgtaccatgtccgccgccgcaaccgagacctgagccgtatcctgagccaaggcccgagccgcgtccggcgccgcagccgaggcctgagccgtatccgcagcccaggcccgcgccttatccgcaaccggagccgaggccagaaccctatccgcaaccccagccaaggccggagccgcgtccggcaccgcagccggccccgcgccttatccgcaaccggagccgaggccagaaccctatccgcagccccagccaaggcccgagccgcgtcctgaatcacagcctcagccaaggccatgtccagaaccgtgcccgagtccagagccatgtccggagcctcagccatgtccagaaccgtgcccgatcccagagccgtgtccggagcctcagccatgtccagaaccgtgcccgatcccagagccgtgtccggagcctcagccttgtccagaaccatacccgcgtccagagccatgcccggaacccgagcctgcacagtgttcaccaaaggataccgtatacggctttaactcaaacaccggaaatgccggtcagtccttggtagcttcccatgacaaaccacaatttgaagttgacgacaggcagggtaatgacacattcgacttttccgggttcaggcagaaccaagtcatcaacctggaggcgggtgcttattcaagtgtcggcggaaaacccaacaatgtttatatcagcccagcgtcggttatcgaaaacgccatcggcggctccggcaatgatcggataatcggcaacgaggccaataacgtattggttgggggcgaaggtgcggacacgctgcgaggtgcagggggacacaatgtcttcaaatacaactcggtagcggactctggctacgcagcggctgatttgctcattgacttcaagaccggctgggacaagattgatttatgcaccctggcgaacactgcgggagtcagtctgaactttgttgccgactttacgggcaaacccggcgatacggttattaaatacaatatgtacagcggtcgctattttttgtcgatcgacctatcgggtaacggcagaagtgactttcttataaaaagtacgcgcccgatcagccctgatgatgtcctgggcctggcttgattacggcgctggctggatgataagcgtgagttgacgcgttgcgtcaacttcatgcctgtcaatgcccggttcagggaatgccacggcacctctgctatacgccgataaaatcactatcttgttacctaatgacaggctgggtcctcgcttgatactgcgtacaagcctgtcgacctgatgtgcgctgctgctttggcggcatcgcgcatgcgcttgtgtcgttggcccagatcgagcccctggcttgatcatatctcccgcacgttgctccaacccaaacccaatatagttttgtccggcgctattgcgccaacggcaggctgttgcatgcctgtttcatataggtctgcatttcctgcagcaaaaccgcgcgtgcctggtcattaggtctttatgccagttgtccataggctcgaggtcggccttgtcagaatgatcggttgtggcagtgtattaatgtacggtgtggcgaaggcgtggatttaataagttgaaaaagctaacggttttcgctcggctcttactcagtattctcttgtttagttgcagcggagtgtaggtaggggagttcgcactggaataccgactccaagctgcgtcttggagtgttatctgtttgtgagtaatgggttgcaatcgaaatggattgtgagtgtgtgagttcttgtttttttaatataaatcagttgcttggcgtagttgtagtggcgtatggggtgcgggtgttgtttcgggacgttgcgcctctgtcgccaaagtattttgagattttagagtgtgtcggagtgcactaattagtgtctggcggacagcgtgtctctgtgcgaacttaagggggtgccgacaagtgctattgctcgtgtggagtgggagtacgatgtcttgggttattgcataaggacttaggttgtatgaaattatcaggaccacccgctattaatatttcgcaagaaaaggagtttgctgcccggggggctatgagttttgagcggttgaggccgtcttacacccccaatagtgaaaaagcgctattcacgactgagcaggctgcaaaacatatcactcggcgtgacttccgatttcatgaccgtaatagtgatcagaagattgacctgtcattccggatttccaaggagttcacaccgcagcaggcagaactggccaggcaagcattgaaatcctggcaggatgtcgccaacgtgacgttcactgaaaacgccgcgaacctcgacggtcacgttgatatcggtgatatgccaggaaccaataacggtgtggcttcactgccaaatcggtacttaagaaatacattcgctaatatcggcacggcagatgcgggcacaaaccctaggcagggcgggttctttcgccaagtactgattcatgaaacaggacatgcaatcgggctggagcacccgggtaaatatgatggttccgggacctatgcaacgcacgccgagtatgccggggacactcgagcccgtagtgtcatgagctatttctcggaaaggaatcaaccggggcatgatttcaattcgctgcatccctctgcgccgatgatggacgacattgctgcggcccagcggctatatggggctaataccaatacgcgtaataccgatacgacctatgggttcaactccaatacgaatcgtgacgccctgagcctgaaaacggccaatgacaatcctgtcttttgtgtgtgggacggtggcggtgacgacacaatggacttctccgggttctctcaggatcagaagatcaatctcaatgccgagtcgttttcagatgtgggggcattgaaaggtaatgtctctattgccaggggcgtcactctggagaacgccgcggggggcaccgggaacgacgctttgataggcaaccacgttgccaatcgcctgaccggtggaggcggagccgacaggttgcgaggcggtggtggtgcagacacgtttgtctatgaccacaccagtgattccactccggataaccctgatgtcatcctcgatttcgagagcggcgtggaccgtctggatgtctctgcgctgttcaaaggaacgaatatcaaggcgctgacattcggcgagcgcctaaccggtcaacctggccaagccgtgttgaactacgacgagggcagtggagagggaagtttggccttggacctgaccggaaatggtaaggctgatgtattgataaagagtattggccggataaatgccgatgatgtgtaccacggcgtcagcccctcggtagacaccgaaccggaaaaaccgaagccggatacgcggcccgagccggaaaagccaaagccggatacgcggcccgagccggaaaagccaaagccggatacgcggcccgagccggaaaagccaaagccggatacgcggcctgaaccgcaaaagccaaatcccgactcacgtccagactcctgtaggcccaagccaaagcccaagccacgcacagtctcgtgtgagtcaaagcctgaaccctgtgcaccgacgccagcctcatgtgtgataagcactatcaacgcacgcgagcatcaagccaatgcgccttccatgaagccggcatatgacgtcgaagccggtgctgatcagcgtcgatcaacattgatttccgcgtctgatcaatgggcttttacagcacgtgcatggggcgggacggttcacgggtaaccggcagggaatatatctgaatgaggcgccctctagggtaggtgatcgctgctcagtgcgtttgagaatgtggtgctggaaagtgcctatgacccattgactagaggcagttaattgtttttttgcatctgccagttgggcggctgagcgcagtattgtcactttatttattgagtttatttttgatttggttgctggctgaaaggcgttttttcgcttgatagttggcgatttgataattcgtaagtgctgtacttgcggagcgtgggttgttgttgtgtataactaactaaagaaggtgtgatgtatgcttaatgtaaatttgcctggtttgaactcctatgtacctacattagatgcggcctctaaaccatccccggcgataccgtcgagtgcctatggcgacagcgggtctgtgggcacttccaacgactcgcattatggaaatagtccatcgctctcaaaagggtccagattgttgagtcttgcgcagacggcaggtgggctttccagcctgcaacggcaatatggatcgaatatgaattcgaactcatcaggtctgctgcaggctggtgaaacgccgatcagcaacaggcttttcttgagtatgggaggagtggacggcaacgttatgactgctaattgcctgcctatgccgaagggggaagagatcaagccaaaagaccagcagtccaagccagctgatgaggagaccaaggccaaaggtgagcagcccaaaccaaccgggatggacgccaagccaaaaggagaccagcccaaaccaaccggtatggacaccaagccacaaggtgagcagcccaaaccaaccgggatggacaccaagccacaaggtgagcagcccaaaccaaccggtgtagacaccaagcc
